United States Patent
Bhatt et al.

(10) Patent No.: US 10,759,855 B2
(45) Date of Patent: Sep. 1, 2020

(54) ANTIGEN BINDING MOLECULES TO TIGIT

(71) Applicant: Rigel Pharmaceuticals, Inc., South San Francisco, CA (US)

(72) Inventors: Ramesh R. Bhatt, Belmont, CA (US); Todd Kinsella, South San Francisco, CA (US); Wei Li, South San Francisco, CA (US)

(73) Assignee: Rigel Pharmaceuticals, Inc., South San Francisco, CA (US)

( * ) Notice: Subject to any disclaimer, the term of this patent is extended or adjusted under 35 U.S.C. 154(b) by 0 days.

(21) Appl. No.: 15/829,422

(22) Filed: Dec. 1, 2017

(65) Prior Publication Data

US 2018/0155422 A1    Jun. 7, 2018

Related U.S. Application Data

(60) Provisional application No. 62/429,639, filed on Dec. 2, 2016.

(51) Int. Cl.
| | | |
|---|---|---|
| *C07K 16/28* | (2006.01) | |
| *A61K 39/395* | (2006.01) | |
| *A61P 17/06* | (2006.01) | |
| *A61P 19/02* | (2006.01) | |
| *A61P 31/18* | (2006.01) | |
| *A61P 1/00* | (2006.01) | |
| *A61P 35/00* | (2006.01) | |

(52) U.S. Cl.
CPC .............. *C07K 16/28* (2013.01); *A61P 1/00* (2018.01); *A61P 17/06* (2018.01); *A61P 19/02* (2018.01); *A61P 31/18* (2018.01); *A61P 35/00* (2018.01); *C07K 16/2803* (2013.01); *C07K 2317/21* (2013.01); *C07K 2317/33* (2013.01); *C07K 2317/55* (2013.01); *C07K 2317/56* (2013.01); *C07K 2317/565* (2013.01); *C07K 2317/567* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | |
|---|---|---|
| 4,399,216 A | 8/1983 | Axel et al. |
| 4,675,187 A | 6/1987 | Konishi et al. |
| 4,740,461 A | 4/1988 | Kaufman |
| 4,816,567 A | 3/1989 | Cabilly et al. |
| 4,912,040 A | 3/1990 | Kaufman et al. |
| 4,946,778 A | 8/1990 | Ladner et al. |
| 4,959,455 A | 9/1990 | Clark et al. |
| 5,260,203 A | 11/1993 | Ladner et al. |
| 5,624,821 A | 4/1997 | Winter et al. |
| 6,005,079 A | 12/1999 | Casterman et al. |
| 6,331,415 B1 | 12/2001 | Cabilly et al. |
| 6,946,292 B2 | 9/2005 | Kanda et al. |
| 7,214,775 B2 | 5/2007 | Hanai et al. |
| 2015/0011736 A1 | 1/2015 | Horowitz et al. |

FOREIGN PATENT DOCUMENTS

| | | |
|---|---|---|
| EP | 0 323997 B1 | 7/1989 |
| EP | 0 338 841 B1 | 10/1989 |
| EP | 0 216846 B1 | 1/1990 |
| EP | 0 404097 B1 | 12/1990 |
| EP | 0 256055 B1 | 8/1991 |
| EP | 1 229125 A1 | 8/2002 |
| WO | WO 1988/001649 | 3/1988 |
| WO | WO 93/11161 | 6/1993 |
| WO | WO 94/04678 | 3/1994 |
| WO | WO 94/25591 | 11/1994 |
| WO | WO 2003/011878 A2 | 2/2003 |
| WO | WO 2003/086310 A2 | 10/2003 |
| WO | WO 2005/120571 | 12/2005 |
| WO | WO 2006/014679 | 2/2006 |
| WO | WO 2006/057702 | 6/2006 |
| WO | WO 2013/109994 | 7/2013 |
| WO | WO 2015/009856 | 1/2015 |
| WO | WO 2016/011264 A1 | 1/2016 |
| WO | WO 2016/028656 | 2/2016 |
| WO | WO 2016/106302 * | 6/2016 |
| WO | WO 2026/191643 | 12/2016 |

OTHER PUBLICATIONS

Altschul et al., "Protein Database Searches Using Compositionally Adjusted Substitution Matrices," The Febs Journal, Oct. 2005, pp. 5101-5109, vol. 272(20).
Altschul et al, "Basic Local Alignment Search Tool," Journal of Molecular Biology, Oct. 4, 1990, pp. 403-410, vol. 215(3).
Altschul et al, "Gapped BLAST and PSI-BLAST: A New Generation of Protein Database Search Programs," Nucleic Acids Research, 1997, pp. 3389-3402, vol. 25(17).
Altschul et al., "Amino Acid Substitution Matrices From An Information Theoretic Perspective," Journal of Molecular Biology, Jun. 5, 1991, pp. 555-565, vol. 219(3).
Altschul et al, "A Protein Alignment Scoring System Sensitive At All Evolutionary Distances," Journal of Molecular Evolution, Mar. 1993, pp. 290-300, vol. 36(3).
Altschul, "Evaluating the Statistical Significance of Multiple Distinct Local Alignments," Theoretical and Computational Methods in Genome Research, In: Suhai S. (ed.), 1997, pp. 1-14, Plenum, New York.
Avis et al., "Pharmaceutical Dosage Forms: Parenteral Medications," Marcel Dekker, Inc., Mar. 1993, vol. 45(3), New York, NY.
Chappel et al., "Identification of A Secondary FcRI Binding Site within a Genetically Engineered Human IgG Antibody*," The Journal of Biological Chemistry, Nov. 25, 1993, pp. 25124-25131, vol. 268(33).
Chothia et al., "Canonical Structures for the Hypervariable Regions of Immunoglobulins," Journal of Molecular Biology, Aug. 1987, pp. 901-917, vol. 196(4).

(Continued)

*Primary Examiner* — Laura B Goddard
(74) *Attorney, Agent, or Firm* — Klarquist Sparkman, LLP

(57) ABSTRACT

Provided herein are antigen binding molecules that bind to TIGIT, include antibodies and antigen binding fragments thereof.

9 Claims, 33 Drawing Sheets

Specification includes a Sequence Listing.

(56) References Cited

OTHER PUBLICATIONS

Chothia et al., "Conformations of Immunoglobulin Hypervariable Regions," Nature Publishing Group, Dec. 28, 1989, pp. 877-883, vol. 342(6252).
Cole et al., "*The EBV-Hybridoma Technique And Its Application To Human Lung Cancer, Monoclonal Antibodies And Cancer Therapy,*" Monoclonal Antibodies and Cancer Therapy, Alan R. Liss, Inc. 1985, pp. 77-96, vol. 27.
Cote et al., "Generation of Human Monoclonal Antibodies Reactive With Cellular Antigens," Proceedings of the National Academy of Sciences of the United States of America, 1983, pp. 2026-2030, vol. 80.
"Cyto Pulse," Cyto Pulse Sciences, Inc., Glen Burnie, MD. The reference is a webpage, and no date of publication is immediately apparent in the document <https://sbir.nih.gov/sites/default/files/CAP_PDFs/CytoPulse.pdf>, accessed on May 2, 2019. A version of this publication may have been available on or before Dec. 2, 2016.
Dayhoff et al.,"22 A Model of Evolutionary Change in Proteins," National Biomedical Research Foundation, 1978, pp. 345-352, vol. 5, Suppl. 3. Silver Spring, MD.
Dembo et al, "Limit Distribution of Maximal Non-Aligned Two-Sequence Segmental Score," The Annals of Probability, 1994, pp. 2022-2039, vol. 22(4).
Genbank Accession No. NP 776160.2. Dated May 2, 2019.
Genbank Accession No. XP 005548157. Dated Sep. 19, 2013.
Gennaro, Remington: The science and Practice of Pharmacy, Thrombolytic Agents; 20th (ed.), 2000, pp. 1256-1257, Lippincott, Williams & Wilkins, New York, NY.
Gish et al., "Identification of Protein Coding Regions By Database Similarity Search," Nature Genetics, Mar. 3, 1993, pp. 266-272, vol. 3.
Giudicelli et al., "IMGT/Gene-DB: A Comprehensive Database for Human and Mouse Immunoglobulin and T Cell Receptor Genes," Nucleic Acids Research, 2005, pp. D256-D261, vol. 33.
"Goodman and Gilman's The Pharmacological Basis of Therapeutics," McGraw-Hill, Hardman (Ed), 2001, New York, NY.
Hagiwara et al., "Generation of Somatic Cell Hybrids Capable of Proliferating and Secreting Human Monoclonal Antibody Without Any Growth Factor Supplements," Human Antibodies Hybridomas, Jan. 1993, p. 15-19, vol. 4(1).
Hancock et al., "SIMPLE34: An Improved and Enhanced Implementation for VAX and Sun Computers of the SIMPLE Algorithm for Analysis of Clustered Repetitive Motifs in Nucleotide Sequences [1994]," Computer Applications in the Biosciences, 1994, pp. 67-70, vol. 10(1).
Henikoff et al, "Amino Acid Substitution Matrices from Protein Blocks," Proceedings of the National Academy of Sciences of the United States of America, Nov. 1992, pp. 10915-10919, vol. 89(22).
Hering et al., "Raji-K562 Hybrids and their Use for Trioma Production," Biomedica Biochimica Acta, Jan. 1, 1988, pp. 211-216, vol. 47(2).
Holliger et al., "'Diabodies': Small Bivalent and Bispecific Antibody Fragments," Proceedings of the National Academy of Sciences of the United States of America, Jul. 1993, pp. 6444-6448, vol. 90.
Holliger et al., "Engineered Antibody Fragments and the Rise of Single Domains," Nature Biotechnology, Sep. 7, 2005, pp. 1126-1136, vol. 23(9).
International Search Report and Written Opinion dated May 16, 2018 in International Patent Application No. PCT/US2017/064307.
Kabat et al., "Sequences of Proteins of Immunological Interest," National Institutes of Public Health, 1991, vol. 91, 5th ed., Bethesda, Md.
Kabat, "The Structural Basis for Antibody Complementary," Advances in Protein Chemistry, 1978, pp. 1-75, vol. 32.
Kabat et al, "Unusual Distributions of Amino Acids in Complementarity-Determining (Hypervariable) Segments of Heavy and Light Chains of Immunoglobulins and their Possible Roles in Specificity of Antibody-Combining Sites," The Journal of Biological Chemistry, Oct. 10, 1977, pp. 6609-6616, vol. 252(19).

Karlin et al, "Methods for Assessing The Statistical Significance Of Molecular Sequence Features By Using General Scoring Schemes," Proceedings of the National Academy of Sciences of the United States of America, Mar. 1990, pp. 2264-2268, vol. 87.
Karlin et al, "Applications and Statistics for Multiple High-Scoring Segments in Molecular Sequences," Proceedings of the National Academy of Sciences of the United States of America, Jun. 1993, pp. 5873-5877, vol. 90, USA.
Kohler et al., "Continuous Cultures of Fused Cells Secreting Antibody of Predefined Specificity," Nature, Aug. 7, 1975, pp. 495-497, vol. 256.
Kozbor et al., "The Production of Monoclonal Antibodies From Human Lymphocytes," Immunology Today, Mar. 1983, p. 72-79, vol. 4(3).
Lazar et al., "Engineered Antibody Fc Variants with Enhanced Effector Function," PNAS, Mar. 14, 2006, pp. 4005-4010, vol. 103(11).
Lee et al., "Prolonged Circulating Lives of Single-Chain Fv Proteins Conjugated with Polyethylene Glycol: A Comparison of Conjugation Chemistries and Compounds," Bioconjugate Chemistry, Nov.-Dec. 1999, pp. 973-981, vol. 10(6).
Lantz et al., "Pharmaceutical Dosage Forms: Tablets," $2^{nd}$ edition, edited by Lieberman, Sep. 1990, pp. 107-200, vol. 2, Marcel Dekker, NY.
Madden et al, "Applications of Network BLAST Server," Methods Enzymology, Jan. 1, 1996, pp. 131-141, vol. 266.
Morrison et al, "Chimeric Human Antibody Molecules: Mouse Antigen-Binding Domains with Human Constant Region Domains," Proceedings of the National Academy of Sciences of the United States of America, Nov. 1984, pp. 6851-6855, vol. 81(21).
Muyldermans et al., "Recognition of Antigens by Single-Domain Antibody Fragments: The Superfluous Luxury of Paired Domains," Trends in Biochemical Sciences, Apr. 1, 2001, pp. 230-235, vol. 26(4).
Nechansky et al., "Compensation of Endogenous IgG Mediated Inhibition of Antibody-Dependent Cellular Cytotoxicity by Glyco-Engineering of Therapeutic Antibodies," Molecular Immunology, Mar. 2007, pp. 1815-1817, vol. 44(7).
Paul et al., "Autoimmunity and Autoimmune Diseases," Fundamental Immunology, Raven Press, 2nd ed., 1989, pp. 819-866, New York.
Physicians' Desk Reference, Thomson Healthcare, Nov. 1, 2002, $56^{th}$ edition.
Physicians' Desk Reference, Thomson Healthcare, Nov. 1, 2003, $57^{th}$ edition.
Pluckthun, "Antibodies from *Escherichia Coli*," The Pharmacology of Monoclonal Antibodies, Handbook of Experimental Pharmacology, Rosenberg and Moore (eds), Springer-Verlag, 1994, pp. 269-315, vol. 113.
Presta, "Selection, Design, and Engineering of Therapeutic Antibodies," Journal of Allergy Clinical Immunology, Oct. 2005, pp. 731-736, vol. 116(4).
Reichmann et al., "Single Domain Antibodies: Comparison of Camel VH and Camelised Human VH Domains," Journal of Immunological Methods, 1999, pp. 25-38, vol. 231.
Remington, "Pharmaceutical Sciences and U.S. Pharmacopeia: National Formulary," Mack Publishing Company, 1984, Easton, PA.
Sambrook et al., "Molecular Cloning: A Laboratory Manual," Cold Spring Harbor Laboratory Press, 1989, Table of Contents Cold Spring Harbor, NY.
Schwartz et al., Matrices for Detecting Distant Relationships. In "Atlas of Protein Sequence and Structure," National Biomedical Research Foundation, Dayhoff (ed.), 1978, pp. 353-358, vol. 5, Supplement 3, Washington, DC.
Shields et al., "High Resolution Mapping of the Binding Site on Human IgG1 for FcyRI, FcyRII, FcyRIII, and FcRn and Design of IgG1 Variants with Improved Binding to the FcyR*," The Journal of Biological Chemistry, Mar. 2, 2001, pp. 6591-6604, vol. 276(9).
Shinkawa et al., "The Absence of Fucose but Not the Presence of Galactose or Bisecting N-Acetylglucosamine of Human IgG1 Complex-type Oligosaccharides Shows the Critical Role of Enhancing Antibody-Dependent Cellular Cytotoxicity*," The Journal of Biological Chemistry, Jan. 31, 2003, pp. 3466-3473, vol. 278(5).

(56) References Cited

OTHER PUBLICATIONS

Stanietksy, N., et al. the Interaction TIGIT with PVR and PVRL2 Inhibits Human NK Cell Cytotoxicity, Proceding fs of the National Academy of Sciences, vol. 106, No. 42m pp. 17858-17863, (2009).

States et al, "Improved Sensitivity of Nucleic Acid Database Searches Using Application-Specific Scoring Matrices," Methods, Aug. 1991, pp. 66-70, vol. 3(1).

Weiner and Kotkoskie et al., "Excipient Toxicity and Safety," Marcel Dekker, Inc., 2000, New York, NY.

Wen, et al., Bioconj. Chem., 2001, pp. 545-553, vol. 12.

Wootton et al, "Statistics of Local Complexity in Amino Acid Sequences and Sequence Databases*," Computers Chemistry, 1993, pp. 149-163, vol. 17(2).

Xu et al, "Combinatorial Surrobody Libraries," Proceedings of the National Academy of Sciences of the United States of America; Aug. 5, 2008, pp. 10756-10761, vol. 105(3).

Zhang et al, "PowerBLAST: A New Network Blast Application for Interactive or Automated Sequence Analysis and Annotation," Genome Research, 1997, pp. 649-656, vol. 7(6).

International Preliminary Report on Patentability, dated Jun. 4, 2019, for U.S. Appl. No. PCT/US2017/064307.

* cited by examiner

FIG. 1

FIG. 2A (ARE) VH

| clone | Vh | SEQ ID NOs. |
|---|---|---|
| Ab58 | EVQLLESGGGLVQPGGSLRLSCAASGFTFSSYAMSWVRQAPGKGLEWVSSIKSSAGSSYYADSVKGRFTISRDNSKNTLYLQMNSLRAEDTAVYYCAREPYDVWIDYWGQGTLVTVSS | SEQ ID NO: 1 |
| Ab69 | EVQLLESGGGLVQPGGSLRLSCAASGFTFSSYSMSWVRQAPGKGLEWVAAIKGSTSSSYYADSVKGRFTISRDNSKNTLYLQMNSLRAEDTAVYYCAREPYDVWLDYWGQGTLVTVSS | SEQ ID NO: 2 |
| Ab75 | EVQLLESGGGLVQPGGSLRLSCAASGFTFSSYSMSWVRQAPGKGLEWVAAIKSNAGTSSYADSVKGRFTISRDNSKNTLYLQMNSLRAEDTAVYYCAREPYDVWLDYWGQGTLVTVSS | SEQ ID NO: 3 |
| Ab133 | EVQLLESGGGLVQPGGSLRLSCAASGFTFSSYAMSWVRQAPGKGLEWVSSISSNTGSISYADSVKGRFTISRDNSKNTLYLQMNSLRAEDTAVYYCAREPYDVWLDYWGQGTLVTVSS | SEQ ID NO: 4 |
| Ab177 | EVQLLESGGGLVQPGGSLRLSCAASGFTFSSYSMSWVRQAPGKGLEWVADISSSASTIGYADSVKGRFTISRDNSKNTLYLQMNSLRAEDTAVYYCAREPYDVWMDYWGQGTLVTVSS | SEQ ID NO: 5 |
| Ab122 | EVQLLESGGGLVQPGGSLRLSCAASGFTFSSYSMSWVRQAPGKGLEWVSAISGSGGSTYYADSVKGRFTISRDNSKNTLYLQMNSLRAEDTAVYYCAREPYDVWMDYWGQGTLVTVSS | SEQ ID NO: 6 |
| Ab86 | EVQLLESGGGLVQPGGSLRLSCAASGFTFSSYSMSWVRQAPGKGLEWVSSISSNTGTSYYADSVKGRFTISRDNSKNTLYLQMNSLRAEDTAVYYCAREPYDVWMDYWGQGTLVTVSS | SEQ ID NO: 7 |
| Ab180 | EVQLLESGGGLVQPGGSLRLSCAASGFTFSSYSMSWVRQAPGKGLEWVSSISSNTGTSYYADSVKGRFTISRDNSKNTLYLQMNSLRAEDTAVYYCAREPYDVWMDYWGQGTLVTVSS | SEQ ID NO: 8 |
| Ab83 | EVQLLESGGGLVQPGGSLRLSCAASGFTFSSYSMSWVRQAPGKGLEWVAAISGSAGTSGYADSVKGRFTISRDNSKNTLYLQMNSLRAEDTAVYYCAREPYDYWLDYWGQGTLVTVSS | SEQ ID NO: 9 |
| Ab26 | EVQLLESGGGLVQPGGSLRLSCAASGFTFSSYSMSWVRQAPGKGLEWVADIKSSGSTKSYADSVKGRFTISRDNSKNTLYLQMNSLRAEDTAVYYCAREPYDYWMDYWGQGTLVTVSS | SEQ ID NO: 10 |
| Ab20 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYDYWMDYWGQGTLVTVSS | SEQ ID NO: 11 |
| Ab147 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYDYWMDYWGQGTLVTVSS | SEQ ID NO: 12 |
| Ab12 | EVQLLESGGGLVQPGGSLRLSCAASGFTFSSYAMSWVRQAPGKGLEWVASINSNGGYKSYADSVKGRFTISRDNSKNTLYLQMNSLRAEDTAVYYCAREPYGIWLDYWGQGTLVTVSS | SEQ ID NO: 13 |
| Ab66 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYGVWIDYWGQGTLVTVSS | SEQ ID NO: 14 |
| Ab176 | EVQLLESGGGLVQPGGSLRLSCAASGFTFSSYSMNWVRQAPGKGLEWVASIKGSASTIYYADSVKGRFTISRDNSKNTLYLQMNSLRAEDTAVYYCAREPYGVWLDYWGQGTLVTVSS | SEQ ID NO: 15 |
| Ab96 | EVQLLESGGGLVQPGGSLRLSCAASGFTFSSYAMSWVRQAPGKGLEWVASIKSNTGSSSYADSVKGRFTISRDNSKNTLYLQMNSLRAEDTAVYYCAREPYGVWLDYWGQGTLVTVSS | SEQ ID NO: 16 |
| Ab123 | EVQLLESGGGLVQPGGSLRLSCAASGFTFSSYSMSWVRQAPGKGLEWVASISSSAGTSSYADSVKGRFTISRDNSKNTLYLQMNSLRAEDTAVYYCAREPYGVWLDYWGQGTLVTVSS | SEQ ID NO: 17 |
| Ab109 | EVQLLESGGGLVQPGGSLRLSCAASGFTFSSYAMSWVRQAPGKGLEWVAYINSNTGTIYYADSVKGRFTISRDNSKNTLYLQMNSLRAEDTAVYYCAREPYGVWLDYWGQGTLVTVSS | SEQ ID NO: 18 |
| Ab149 | EVQLLESGGGLVQPGGSLRLSCAASGFTFSSYAMSWVRQAPGKGLEWVAYISGNTGYIGYADSVKGRFTISRDNSKNTLYLQMNSLRAEDTAVYYCAREPYGVWLDYWGQGTLVTVSS | SEQ ID NO: 19 |
| Ab34 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYGVWLDYWGQGTLVTVSS | SEQ ID NO: 20 |
| Ab61 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYGVWLDYWGQGTLVTVSS | SEQ ID NO: 21 |
| Ab64 | EVQLLESGGGLVQPGGSLRLSCAASGFTFSSYSMSWVRQAPGKGLEWVSAISSNAGSTSYADSVKGRFTISRDNSKNTLYLQMNSLRAEDTAVYYCAREPYGVWLDYWGQGTLVTVSS | SEQ ID NO: 22 |
| Ab105 | EVQLLESGGGLVQPGGSLRLSCAASGFTFSSYSMSWVRQAPGKGLEWVSSINSNAGTTYYADSVKGRFTISRDNSKNTLYLQMNSLRAEDTAVYYCAREPYGVWLDYWGQGTLVTVSS | SEQ ID NO: 23 |
| Ab108 | EVQLLESGGGLVQPGGSLRLSCAASGFTFSSYSMSWVRQAPGKGLEWVSSINSNAGTTYYADSVKGRFTISRDNSKNTLYLQMNSLRAEDTAVYYCAREPYGVWLDYWGQGTLVTVSS | SEQ ID NO: 24 |
| Ab178 | EVQLLESGGGLVQPGGSLRLSCAASGFTFDSYSMNWVRQAPGKGLEWVAAIKSDASTIGYADSVKGRFTISRDNSKNTLYLQMNSLRAEDTAVYYCAREPYGVWMDYWGQGTLVTVSS | SEQ ID NO: 25 |
| Ab166 | EVQLLESGGGLVQPGGSLRLSCAASGFTFSSYSMNWVRQAPGKGLEWVAAISGSTGTISYADSVKGRFTISRDNSKNTLYLQMNSLRAEDTAVYYCAREPYGVWMDYWGQGTLVTVSS | SEQ ID NO: 26 |
| Ab29 | EVQLLESGGGLVQPGGSLRLSCAASGFTFSSYGMNWVRQAPGKGLEWVANINSNSGSIYYADSVKGRFTISRDNSKNTLYLQMNSLRAEDTAVYYCAREPYGVWMDYWGQGTLVTVSS | SEQ ID NO: 27 |

FIG. 2B (ARE) VH

| clone | Vh | SEQ ID NOs. |
|---|---|---|
| Ab135 | EVQLLESGGGLVQPGGSLRLSCAASGFTFDSYAMNWVRQAPGKGLEWVASINSNTGSIYYADSVKGRFTISRDNSKNTLYLQMNSLRAEDTAVYYCAREPYGVWMDYWGQGTLVTVSS | SEQ ID NO: 28 |
| Ab171 | EVQLLESGGGLVQPGGSLRLSCAASGFTFDSYAMNWVRQAPGKGLEWVASINSNTGSIYYADSVKGRFTISRDNSKNTLYLQMNSLRAEDTAVYYCAREPYGVWMDYWGQGTLVTVSS | SEQ ID NO: 29 |
| Ab194 | EVQLLESGGGLVQPGGSLRLSCAASGFTFSSYSMSWVRQAPGKGLEWVSAINGNAGSIGYADSVKGRFTISRDNSKNTLYLQMNSLRAEDTAVYYCAREPYGVWMDYWGQGTLVTVSS | SEQ ID NO: 30 |
| Ab184 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYGVWMDYWGQGTLVTVSS | SEQ ID NO: 31 |
| Ab164 | EVQLLESGGGLVQPGGSLRLSCAASGFTFSSYAMSWVRQAPGKGLEWVSYINSNTGSIGYADSVKGRFTISRDNSKNTLYLQMNSLRAEDTAVYYCAREPYGVWMDYWGQGTLVTVSS | SEQ ID NO: 32 |
| Ab183 | EVQLLESGGGLVQPGGSLRLSCAASGFTFSSYAMSWVRQAPGKGLEWVSYINSNTGSIGYADSVKGRFTISRDNSKNTLYLQMNSLRAEDTAVYYCAREPYGVWMDYWGQGTLVTVSS | SEQ ID NO: 33 |
| Ab158 | EVQLLESGGGLVQPGGSLRLSCAASGFTFSSYSMSWVRQAPGKGLEWVAAIKGSAGTSGYADSVKGRFTISRDNSKNTLYLQMNSLRAEDTAVYYCAREPYGYWLDYWGQGTLVTVSS | SEQ ID NO: 34 |
| Ab55 | EVQLLESGGGLVQPGGSLRLSCAASGFTFSSYAMSWVRQAPGKGLEWVASISGNTGTSSYADSVKGRFTISRDNSKNTLYLQMNSLRAEDTAVYYCAREPYGYWLDYWGQGTLVTVSS | SEQ ID NO: 35 |
| Ab136 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYGYWLDYWGQGTLVTVSS | SEQ ID NO: 36 |
| Ab39 | EVQLLESGGGLVQPGGSLRLSCAASGFTFSSYAMSWVRQAPGKGLEWVSSIWSNGGSIYYADSVKGRFTISRDNSKNTLYLQMNSLRAEDTAVYYCAREPYGYWLDYWGQGTLVTVSS | SEQ ID NO: 37 |
| Ab159 | EVQLLESGGGLVQPGGSLRLSCAASGFTFSSYSMNWVRQAPGKGLEWVASIKSSTGTTGYADSVKGRFTISRDNSKNTLYLQMNSLRAEDTAVYYCAREPYGYWMDYWGQGTLVTVSS | SEQ ID NO: 38 |
| Ab151 | EVQLLESGGGLVQPGGSLRLSCAASGFTFSSYAMSWVRQAPGKGLEWVASIKSSTGYISYADSVKGRFTISRDNSKNTLYLQMNSLRAEDTAVYYCAREPYGYWMDYWGQGTLVTVSS | SEQ ID NO: 39 |
| Ab139 | EVQLLESGGGLVQPGGSLRLSCAASGFTFSSYSMSWVRQAPGKGLEWVASISGSASYSYYADSVKGRFTISRDNSKNTLYLQMNSLRAEDTAVYYCAREPYGYWMDYWGQGTLVTVSS | SEQ ID NO: 40 |
| Ab107 | EVQLLESGGGLVQPGGSLRLSCAASGFTFSSYSMSWVRQAPGKGLEWVSDIKSSAGSTYYADSVKGRFTISRDNSKNTLYLQMNSLRAEDTAVYYCAREPYGYWMDYWGQGTLVTVSS | SEQ ID NO: 41 |
| Ab36 | EVQLLESGGGLVQPGGSLRLSCAASGFTFSSYAMSWVRQAPGKGLEWVASIKSSGSYKSYADSVKGRFTISRDNSKNTLYLQMNSLRAEDTAVYYCAREPYSTWLDYWGQGTLVTVSS | SEQ ID NO: 42 |
| Ab193 | EVQLLESGGGLVQPGGSLRLSCAASGFTFSSYAMSWVRQAPGKGLEWVSAIKSDTSTIYYADSVKGRFTISRDNSKNTLYLQMNSLRAEDTAVYYCAREPYSTWLDYWGQGTLVTVSS | SEQ ID NO: 43 |
| Ab115 | EVQLLESGGGLVQPGGSLRLSCAASGFTFSSYAMSWVRQAPGKGLEWVAAIKGNAGSTYADSVKGRFTISRDNSKNTLYLQMNSLRAEDTAVYYCAREPYSTWMDYWGQGTLVTVSS | SEQ ID NO: 44 |
| Ab106 | EVQLLESGGGLVQPGGSLRLSCAASGFTFSSYAMNWVRQAPGKGLEWVASIKSSTGTISYADSVKGRFTISRDNSKNTLYLQMNSLRAEDTAVYYCAREPYSVWIDYWGQGTLVTVSS | SEQ ID NO: 45 |
| Ab138 | EVQLLESGGGLVQPGGSLRLSCAASGFTFSSYAMSWVRQAPGKGLEWVASIKSSTGTTGYADSVKGRFTISRDNSKNTLYLQMNSLRAEDTAVYYCAREPYSVWIDYWGQGTLVTVSS | SEQ ID NO: 46 |
| Ab127 | EVQLLESGGGLVQPGGSLRLSCAASGFTFSSYAMNWVRQAPGKGLEWVAYIKSDTGSIGYADSVKGRFTISRDNSKNTLYLQMNSLRAEDTAVYYCAREPYSVWIDYWGQGTLVTVSS | SEQ ID NO: 47 |
| Ab165 | EVQLLESGGGLVQPGGSLRLSCAASGFTFSSYAMSWVRQAPGKGLEWVAAIKSSTGTIYYADSVKGRFTISRDNSKNTLYLQMNSLRAEDTAVYYCAREPYSVWLDYWGQGTLVTVSS | SEQ ID NO: 48 |
| Ab155 | EVQLLESGGGLVQPGGSLRLSCAASGFTFSSYSMNWVRQAPGKGLEWVAAISGDTGSGYADSVKGRFTISRDNSKNTLYLQMNSLRAEDTAVYYCAREPYSVWLDYWGQGTLVTVSS | SEQ ID NO: 49 |
| Ab19 | EVQLLESGGGLVQPGGSLRLSCAASGFTFSSYSMSWVRQAPGKGLEWVANIKSNSGYTYYADSVKGRFTISRDNSKNTLYLQMNSLRAEDTAVYYCAREPYSVWLDYWGQGTLVTVSS | SEQ ID NO: 50 |
| Ab6 | EVQLLESGGGLVQPGGSLRLSCAASGFTFSDYSMSWVRQAPGKGLEWVARISSSSYKSYADSVKGRFTISRDNSKNTLYLQMNSLRAEDTAVYYCAREPYSVWLDYWGQGTLVTVSS | SEQ ID NO: 51 |
| Ab187 | EVQLLESGGGLVQPGGSLRLSCAASGFTFSSYSMSWVRQAPGKGLEWVASIKSDASTTGYADSVKGRFTISRDNSKNTLYLQMNSLRAEDTAVYYCAREPYSVWLDYWGQGTLVTVSS | SEQ ID NO: 52 |
| Ab179 | EVQLLESGGGLVQPGGSLRLSCAASGFTFSSYAMSWVRQAPGKGLEWVASIKSNTGSTYYADSVKGRFTISRDNSKNTLYLQMNSLRAEDTAVYYCAREPYSVWLDYWGQGTLVTVSS | SEQ ID NO: 53 |
| Ab65 | EVQLLESGGGLVQPGGSLRLSCAASGFTFSSYAMSWVRQAPGKGLEWVAYIKSNTGSISYADSVKGRFTISRDNSKNTLYLQMNSLRAEDTAVYYCAREPYSVWLDYWGQGTLVTVSS | SEQ ID NO: 54 |

FIG. 2C

(ARE) VH

| clone | Vh | SEQ ID NOs. |
|---|---|---|
| Ab114 | EVQLLESGGGLVQPGGSLRLSCAASGFTFSSYSMSWVRQAPGKGLEWVAYISSNTGSTYYADSVKGRFTISRDNSKNTLYLQMNSLRAEDTAVYYCAREPYSVWLDYWGQGTLVTVSS | SEQ ID NO: 55 |
| Ab102 | EVQLLESGGGLVQPGGSLRLSCAASGFTFSSYAMSWVRQAPGKGLEWVSAINSNAGYTYYADSVKGRFTISRDNSKNTLYLQMNSLRAEDTAVYYCAREPYSVWLDYWGQGTLVTVSS | SEQ ID NO: 56 |
| Ab94 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSVWLDYWGQGTLVTVSS | SEQ ID NO: 57 |
| Ab163 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSVWLDYWGQGTLVTVSS | SEQ ID NO: 58 |
| Ab110 | EVQLLESGGGLVQPGGSLRLSCAASGFTFSSYAMSWVRQAPGKGLEWVSSIKSNTGSTYYADSVKGRFTISRDNSKNTLYLQMNSLRAEDTAVYYCAREPYSVWLDYWGQGTLVTVSS | SEQ ID NO: 59 |
| Ab80 | EVQLLESGGGLVQPGGSLRLSCAASGFTFSSYSMSWVRQAPGKGLEWVSSIKSSTGSTYYADSVKGRFTISRDNSKNTLYLQMNSLRAEDTAVYYCAREPYSVWLDYWGQGTLVTVSS | SEQ ID NO: 60 |
| Ab92 | EVQLLESGGGLVQPGGSLRLSCAASGFTFSSYAMSWVRQAPGKGLEWVAAIKSSASTIYYADSVKGRFTISRDNSKNTLYLQMNSLRAEDTAVYYCAREPYSVWMDYWGQGTLVTVSS | SEQ ID NO: 61 |
| Ab117 | EVQLLESGGGLVQPGGSLRLSCAASGFTFSSYAMSWVRQAPGKGLEWVAAIKSSASTIYYADSVKGRFTISRDNSKNTLYLQMNSLRAEDTAVYYCAREPYSVWMDYWGQGTLVTVSS | SEQ ID NO: 62 |
| Ab162 | EVQLLESGGGLVQPGGSLRLSCAASGFTFSSYAMSWVRQAPGKGLEWVAAIKSSASTIYYADSVKGRFTISRDNSKNTLYLQMNSLRAEDTAVYYCAREPYSVWMDYWGQGTLVTVSS | SEQ ID NO: 63 |
| Ab121 | EVQLLESGGGLVQPGGSLRLSCAASGFTFSSYAMNWVRQAPGKGLEWVAAISSSAGTSSYADSVKGRFTISRDNSKNTLYLQMNSLRAEDTAVYYCAREPYSVWMDYWGQGTLVTVSS | SEQ ID NO: 64 |
| Ab195 | EVQLLESGGGLVQPGGSLRLSCAASGFTFSSYAMSWVRQAPGKGLEWVADISGSASSSYYADSVKGRFTISRDNSKNTLYLQMNSLRAEDTAVYYCAREPYSVWMDYWGQGTLVTVSS | SEQ ID NO: 65 |
| Ab84 | EVQLLESGGGLVQPGGSLRLSCAASGFTFSSYAMSWVRQAPGKGLEWVASIKSSTGTSYYADSVKGRFTISRDNSKNTLYLQMNSLRAEDTAVYYCAREPYSVWMDYWGQGTLVTVSS | SEQ ID NO: 66 |
| Ab161 | EVQLLESGGGLVQPGGSLRLSCAASGFTFSSYSMSWVRQAPGKGLEWVASIKSSTGYTSYADSVKGRFTISRDNSKNTLYLQMNSLRAEDTAVYYCAREPYSVWMDYWGQGTLVTVSS | SEQ ID NO: 67 |
| Ab198 | EVQLLESGGGLVQPGGSLRLSCAASGFTFSSYAMSWVRQAPGKGLEWVASIKSSTSSTYYADSVKGRFTISRDNSKNTLYLQMNSLRAEDTAVYYCAREPYSVWMDYWGQGTLVTVSS | SEQ ID NO: 68 |
| Ab24 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSVWMDYWGQGTLVTVSS | SEQ ID NO: 69 |
| Ab98 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSVWMDYWGQGTLVTVSS | SEQ ID NO: 70 |
| Ab116 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSVWMDYWGQGTLVTVSS | SEQ ID NO: 71 |
| Ab174 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSVWMDYWGQGTLVTVSS | SEQ ID NO: 72 |
| Ab196 | EVQLLESGGGLVQPGGSLRLSCAASGFTFSSYSMNWVRQAPGKGLEWVSSIKGSAGTTSYADSVKGRFTISRDNSKNTLYLQMNSLRAEDTAVYYCAREPYSVWMDYWGQGTLVTVSS | SEQ ID NO: 73 |
| Ab51 | EVQLLESGGGLVQPGGSLRLSCAASGFTFSSYAMSWVRQAPGKGLEWVSSIKSNSGSKSYADSVKGRFTISRDNSKNTLYLQMNSLRAEDTAVYYCAREPYSVWMDYWGQGTLVTVSS | SEQ ID NO: 74 |
| Ab91 | EVQLLESGGGLVQPGGSLRLSCAASGFTFSSYSMSWVRQAPGKGLEWVAAIKGSAGSSSYADSVKGRFTISRDNSKNTLYLQMNSLRAEDTAVYYCAREPYSYWLDYWGQGTLVTVSS | SEQ ID NO: 75 |
| Ab185 | EVQLLESGGGLVQPGGSLRLSCAASGFTFSSYAMSWVRQAPGKGLEWVAAIKSNAGSSYADSVKGRFTISRDNSKNTLYLQMNSLRAEDTAVYYCAREPYSYWLDYWGQGTLVTVSS | SEQ ID NO: 76 |
| Ab23 | EVQLLESGGGLVQPGGSLRLSCAASGFTFSSYAMSWVRQAPGKGLEWVARINSDSSNTYYADSVKGRFTISRDNSKNTLYLQMNSLRAEDTAVYYCAREPYSYWLDYWGQGTLVTVSS | SEQ ID NO: 77 |
| Ab7 | EVQLLESGGGLVQPGGSLRLSCAASGFTFSSYAMSWVRQAPGKGLEWVASIKSSSSISYADSVKGRFTISRDNSKNTLYLQMNSLRAEDTAVYYCAREPYSYWLDYWGQGTLVTVSS | SEQ ID NO: 78 |
| Ab95 | EVQLLESGGGLVQPGGSLRLSCAASGFTFSSYAMSWVRQAPGKGLEWVASIKSSTGYIGYADSVKGRFTISRDNSKNTLYLQMNSLRAEDTAVYYCAREPYSYWLDYWGQGTLVTVSS | SEQ ID NO: 79 |
| Ab100 | EVQLLESGGGLVQPGGSLRLSCAASGFTFSSYAMSWVRQAPGKGLEWVASINGNAGTISYADSVKGRFTISRDNSKNTLYLQMNSLRAEDTAVYYCAREPYSYWLDYWGQGTLVTVSS | SEQ ID NO: 80 |
| Ab140 | EVQLLESGGGLVQPGGSLRLSCAASGFTFSSYAMSWVRQAPGKGLEWVASINSNTGSIGYADSVKGRFTISRDNSKNTLYLQMNSLRAEDTAVYYCAREPYSYWLDYWGQGTLVTVSS | SEQ ID NO: 81 |

FIG. 2D
(ARE) VH

| clone | Vh | SEQ ID NOs. |
|---|---|---|
| Ab145 | EVQLLESGGGLVQPGGSLRLSCAASGFTFSSYAMSWVRQAPGKGLEWVASISSSTGYTSYADSVKGRFTISRDNSKNTLYLQMNSLRAEDTAVYYCAREPYSYWLDYWGQGTLVTVSS | SEQ ID NO: 82 |
| Ab150 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSYWLDYWGQGTLVTVSS | SEQ ID NO: 83 |
| Ab168 | EVQLLESGGGLVQPGGSLRLSCAASGFTFSSYAMSWVRQAPGKGLEWVSSIKSDTSSTYYADSVKGRFTISRDNSKNTLYLQMNSLRAEDTAVYYCAREPYSYWLDYWGQGTLVTVSS | SEQ ID NO: 84 |
| Ab54 | EVQLLESGGGLVQPGGSLRLSCAASGFTFSSYAMSWVRQAPGKGLEWVSSIKSNTGSTYYADSVKGRFTISRDNSKNTLYLQMNSLRAEDTAVYYCAREPYSYWLDYWGQGTLVTVSS | SEQ ID NO: 85 |
| Ab77 | EVQLLESGGGLVQPGGSLRLSCAASGFTFSSYSMNWVRQAPGKGLEWVAAISGNTGYTYYADSVKGRFTISRDNSKNTLYLQMNSLRAEDTAVYYCAREPYSYWMDYWGQGTLVTVSS | SEQ ID NO: 86 |
| Ab43 | EVQLLESGGGLVQPGGSLRLSCAASGFTFSSYAMSWVRQAPGKGLEWVANIKSNSGYTSYADSVKGRFTISRDNSKNTLYLQMNSLRAEDTAVYYCAREPYSYWMDYWGQGTLVTVSS | SEQ ID NO: 87 |
| Ab160 | EVQLLESGGGLVQPGGSLRLSCAASGFTFDSYAMNWVRQAPGKGLEWVASIKSNAGYSSYADSVKGRFTISRDNSKNTLYLQMNSLRAEDTAVYYCAREPYSYWMDYWGQGTLVTVSS | SEQ ID NO: 88 |
| Ab82 | EVQLLESGGGLVQPGGSLRLSCAASGFTFSSYAMNWVRQAPGKGLEWVASIKSNTGTTGYADSVKGRFTISRDNSKNTLYLQMNSLRAEDTAVYYCAREPYSYWMDYWGQGTLVTVSS | SEQ ID NO: 89 |
| Ab189 | EVQLLESGGGLVQPGGSLRLSCAASGFTFSSYSMSWVRQAPGKGLEWVASIKSSASYSSYADSVKGRFTISRDNSKNTLYLQMNSLRAEDTAVYYCAREPYSYWMDYWGQGTLVTVSS | SEQ ID NO: 90 |
| Ab17 | EVQLLESGGGLVQPGGSLRLSCAASGFTFSSYAMSWVRQAPGKGLEWVASIKSSGGNTYYADSVKGRFTISRDNSKNTLYLQMNSLRAEDTAVYYCAREPYSYWMDYWGQGTLVTVSS | SEQ ID NO: 91 |
| Ab103 | EVQLLESGGGLVQPGGSLRLSCAASGFTFSSYAMSWVRQAPGKGLEWVASIKSSTSSTYYADSVKGRFTISRDNSKNTLYLQMNSLRAEDTAVYYCAREPYSYWMDYWGQGTLVTVSS | SEQ ID NO: 92 |
| Ab18 | EVQLLESGGGLVQPGGSLRLSCAASGFTFSSYAMSWVRQAPGKGLEWVASISSSGGNTYYADSVKGRFTISRDNSKNTLYLQMNSLRAEDTAVYYCAREPYSYWMDYWGQGTLVTVSS | SEQ ID NO: 93 |
| Ab130 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSYWMDYWGQGTLVTVSS | SEQ ID NO: 94 |
| Ab132 | EVQLLESGGGLVQPGGSLRLSCAASGFTFSSYAMNWVRQAPGKGLEWVSSISGNAGSIYYADSVKGRFTISRDNSKNTLYLQMNSLRAEDTAVYYCAREPYSYWMDYWGQGTLVTVSS | SEQ ID NO: 95 |
| Ab134 | EVQLLESGGGLVQPGGSLRLSCAASGFTFSSYAMNWVRQAPGKGLEWVSSISGNAGSIYYADSVKGRFTISRDNSKNTLYLQMNSLRAEDTAVYYCAREPYSYWMDYWGQGTLVTVSS | SEQ ID NO: 96 |
| Ab144 | EVQLLESGGGLVQPGGSLRLSCAASGFTFSSYAMNWVRQAPGKGLEWVSSISGNAGSIYYADSVKGRFTISRDNSKNTLYLQMNSLRAEDTAVYYCAREPYSYWMDYWGQGTLVTVSS | SEQ ID NO: 97 |

FIG. 2E (ARE) VL

| clone | VL | SEQ ID NOs.. |
|---|---|---|
| Ab58 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 98 |
| Ab69 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 99 |
| Ab75 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 100 |
| Ab133 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 101 |
| Ab177 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 102 |
| Ab122 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 103 |
| Ab86 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 104 |
| Ab180 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 105 |
| Ab83 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 106 |
| Ab26 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 107 |
| Ab20 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 108 |
| Ab147 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 109 |
| Ab12 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 110 |
| Ab66 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 111 |
| Ab176 | DIQMTQSPSSLSASVGDRVTITCRASQSISYYVNFYQQKPGKAPKLLIYAASSLQSGVPSRFSGSGSGTDFTLTISSLQPEDFATYYCQQSYSTPLTFGGGTKVEIK | SEQ ID NO: 112 |
| Ab96 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 113 |
| Ab123 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 114 |
| Ab109 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 115 |
| Ab149 | DIQMTQSPSSLSASVGDRVTITCRASQSISSYANWYQQKPGKAPKLVIYGNSSRESGVPSRFSGSGSGTDFTLTISSLQPEDFATYYCQQSGDSNLTFGGGTKVEIK | SEQ ID NO: 116 |
| Ab34 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 117 |
| Ab61 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 118 |
| Ab64 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 119 |
| Ab105 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 120 |
| Ab108 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 121 |
| Ab178 | DIQMTQSPSSLSASVGDRVTITCRASQSISYYVNWYQQKPGKAPKLLIYAASSLQSGVPSRFSGSGSGTDFTLTISSLQPEDFATYYCQQSYSTPLTFGGGTKVEIK | SEQ ID NO: 122 |
| Ab166 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 123 |
| Ab29 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 124 |

FIG. 2F (ARE) VL

| clone | VL | SEQ ID NOs.. |
|---|---|---|
| Ab135 | DIQMTQSPSSLSASVGDRVTITCRASQSISSYANWYQQKPGKAPKLLIYAASSLQSGVPSRFSGSGSGTDFTLT ISSLQPEDFATYYCQQSYSTPLTFGGGTKVEIK | SEQ ID NO: 125 |
| Ab171 | DIQMTQSPSSLSASVGDRVTITCRASQSISSYANWYQQKPGKAPKLLIYAASSLQSGVPSRFSGSGSGTDFTLT ISSLQPEDFATYYCQQSYSTPLTFGGGTKVEIK | SEQ ID NO: 126 |
| Ab194 | DIQMTQSPSSLSASVGDRVTITCRASQSISYYLNWYQQKPGKAPKLLIYAASSLQSGVPSRFSGSGSGTDFTLT ISSLQPEDFATYYCQQSYSTPLTFGGGTKVEIK | SEQ ID NO: 127 |
| Ab184 | DIQMTQSPSSLSASVGDRVTITCRASQSISYYLNWYQQKPGKAPKLLIYAASSLQSGVPSRFSGSGSGTDFTLT ISSLQPEDFATYYCQQSYSTPLTFGGGTKVEIK | SEQ ID NO: 128 |
| Ab164 | DIQMTQSPSSLSASVGDRVTITCRASQSISYYLNWYQQKPGKAPKLLIYAASSLQSGVPSRFSGSGSGTDFTLT ISSLQPEDFATYYCQQSYSTPLTFGGGTKVEIK | SEQ ID NO: 129 |
| Ab183 | DIQMTQSPSSLSASVGDRVTITCRASQSISYYLNWYQQKPGKAPKLLIYAASSLQSGVPSRFSGSGSGTDFTLT ISSLQPEDFATYYCQQSYSTPLTFGGGTKVEIK | SEQ ID NO: 130 |
| Ab158 | DIQMTQSPSSLSASVGDRVTITCRASQSISSYVAWYQQKPGKAPKLLIYGNTSLQSGVPSRFSGSGSGTDFTLT ISSLQPEDFATYYCQQGDENPLTFGGGTKVEIK | SEQ ID NO: 131 |
| Ab55 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 132 |
| Ab136 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 133 |
| Ab39 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 134 |
| Ab159 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 135 |
| Ab151 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 136 |
| Ab139 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 137 |
| Ab107 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 138 |
| Ab36 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 139 |
| Ab193 | DIQMTQSPSSLSASVGDRVTITCRASQSISYYLNWYQQKPGKAPKLLIYAASSLQSGVPSRFSGSGSGTDFTLT ISSLQPEDFATYYCQQSYSTPLTFGGGTKVEIK | SEQ ID NO: 140 |
| Ab115 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 141 |
| Ab106 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 142 |
| Ab138 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 143 |
| Ab127 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 144 |
| Ab165 | DIQMTQSPSSLSASVGDRVTITCRASQSIIYYLNWYQQKPGKAPKLLIYAASSLQSGVPSRFSGSGSGTDFTLT ISSLQPEDFATYYCQQSYSTPLTFGGGTKVEIK | SEQ ID NO: 145 |
| Ab155 | DIQMTQSPSSLSASVGDRVTITCRASQSISYYLNWYQQKPGKAPKLLIYAASSLQSGVPSRFSGSGSGTDFTLT ISSLQPEDFATYYCQQSYSTPLTFGGGTKVEIK | SEQ ID NO: 146 |
| Ab19 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 147 |
| Ab6 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 148 |
| Ab187 | DIQMTQSPSSLSASVGDRVTITCRASQSISYYLNWYQQKPGKAPKLLIYAASSLQSGVPSRFSGSGSGTDFTLT ISSLQPEDFATYYCQQSYSTPLTFGGGTKVEIK | SEQ ID NO: 149 |
| Ab179 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 150 |
| Ab65 | DIQMTQSPSSLSASVGDRVTITCRASQSISSYLNWYQQKPGKAPKLLIYAASSLQSGVPSRFSGSGSGTDFTLT ISSLQPEDFATYYCQQSYSTPLTFGGGTKVEIK | SEQ ID NO: 151 |

FIG. 2G (ARE) VL

| clone | VL | SEQ ID NOs.. |
|---|---|---|
| Ab114 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 152 |
| Ab102 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 153 |
| Ab94 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 154 |
| Ab163 | DIQMTQSPSSLSASVGDRVTITCRASQSISYYANWYQQKPGKAPKLLIYAASSLQSGVPSRFSGSGSGTDFTLTISSLQPEDFATYYCQQSYSTPLTFGGGTKVEIK | SEQ ID NO: 155 |
| Ab110 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 156 |
| Ab80 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 157 |
| Ab92 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 158 |
| Ab117 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 159 |
| Ab162 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 160 |
| Ab121 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 161 |
| Ab195 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 162 |
| Ab84 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 163 |
| Ab161 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 164 |
| Ab198 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 165 |
| Ab24 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 166 |
| Ab98 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 167 |
| Ab116 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 168 |
| Ab174 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 169 |
| Ab196 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 170 |
| Ab51 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 171 |
| Ab91 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 172 |
| Ab185 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 173 |
| Ab23 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 174 |
| Ab7 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 175 |
| Ab95 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 176 |
| Ab100 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 177 |
| Ab140 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 178 |

FIG. 2H (ARE) VL

| clone | VL | SEQ ID NOs.. |
|---|---|---|
| Ab145 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 179 |
| Ab150 | DIQMTQSPSSLSASVGDRVTITCRASQSISSYVAWYQQKPGKAPKLLIYVNTSRASGVPSRFSGSGSGTDFTLTISSLQPEDFATYYCQQWYEFNLTFGGGTKVEIK | SEQ ID NO: 180 |
| Ab168 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 181 |
| Ab54 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 182 |
| Ab77 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 183 |
| Ab43 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 184 |
| Ab160 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 185 |
| Ab82 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 186 |
| Ab189 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 187 |
| Ab17 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 188 |
| Ab103 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 189 |
| Ab18 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 190 |
| Ab130 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 191 |
| Ab132 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 192 |
| Ab134 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 193 |
| Ab144 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 194 |

FIG. 21

(ARG) VH

| clone | Vh | SEQ ID NOs. |
|---|---|---|
| Ab2 | EVQLLESGGGLVQPGGSLRLSCAASGFTFSSYGMNWVRQAPGKGLEWVAGINYSSGNKYYADSVKGRFTISRD NSKNTLYLQMNSLRAEDTAVYYCARGPYASTWLDYWGQGTLVTVSS | SEQ ID NO: 195 |
| Ab47 | EVQLLESGGGLVQPGGSLRLSCAASGFTFSSYSMNWVRQAPGKGLEWVASIKSSSSYTSYADSVKGRFTISRD NSKNTLYLQMNSLRAEDTAVYYCARGPYDTWLDYWGQGTLVTVSS | SEQ ID NO: 196 |
| Ab49 | EVQLLESGGGLVQPGGSLRLSCAASGFTFSSYSMHWVRQAPGKGLEWVASIKSSGGYKSYADSVKGRFTISRD NSKNTLYLQMNSLRAEDTAVYYCARGPYDVWIDYWGQGTLVTVSS | SEQ ID NO: 197 |
| Ab31 | EVQLLESGGGLVQPGGSLRLSCAASGFTFSSYTMHWVRQAPGKGLEWVANIKSSSSTKYYADSVKGRFTISRD NSKNTLYLQMNSLRAEDTAVYYCARGPYDVWLDYWGQGTLVTVSS | SEQ ID NO: 198 |
| Ab53 | EVQLLESGGGLVQPGGSLRLSCAASGFTFSSYSMHWVRQAPGKGLEWVASIKSSSSNKYYADSVKGRFTISRD NSKNTLYLQMNSLRAEDTAVYYCARGPYDVWLDYWGQGTLVTVSS | SEQ ID NO: 199 |
| Ab40 | EVQLLESGGGLVQPGGSLRLSCAASGFTFSSYGMNWVRQAPGKGLEWVAGIKYSSGNKYYADSVKGRFTISRD NSKNTLYLQMNSLRAEDTAVYYCARGPYDVWMDYWGQGTLVTVSS | SEQ ID NO: 200 |
| Ab5 | EVQLLESGGGLVQPGGSLRLSCAASGFTFSDYSMNWVRQAPGKGLEWVALIKSNSGSTSYADSVKGRFTISRD NSKNTLYLQMNSLRAEDTAVYYCARGPYDVWMDYWGQGTLVTVSS | SEQ ID NO: 201 |
| Ab9 | EVQLLESGGGLVQPGGSLRLSCAASGFTFDSYSMHWVRQAPGKGLEWVANIKSSGGYISYADSVKGRFTISRD NSKNTLYLQMNSLRAEDTAVYYCARGPYDVWMDYWGQGTLVTVSS | SEQ ID NO: 202 |
| Ab48 | EVQLLESGGGLVQPGGSLRLSCAASGFTFSSYSMNWVRQAPGKGLEWVANIKSGSSTSYADSVKGRFTISRD NSKNTLYLQMNSLRAEDTAVYYCARGPYDVWMDYWGQGTLVTVSS | SEQ ID NO: 203 |
| Ab4 | EVQLLESGGGLVQPGGSLRLSCAASGFTFDSYGMNWVRQAPGKGLEWVASIKYSSGYKYYADSVKGRFTISRD NSKNTLYLQMNSLRAEDTAVYYCARGPYDVWMDYWGQGTLVTVSS | SEQ ID NO: 204 |
| Ab10 | EVQLLESGGGLVQPGGSLRLSCAASGFTFSSYSMNWVRQAPGKGLEWVAYIKSNSGTKGYADSVKGRFTISRD NSKNTLYLQMNSLRAEDTAVYYCARGPYDYWLDYWGQGTLVTVSS | SEQ ID NO: 205 |
| Ab37 | EVQLLESGGGLVQPGGSLRLSCAASGFTFSSYGMNWVRQAPGKGLEWVSDINSNSGSTSYADSVKGRFTISRD NSKNTLYLQMNSLRAEDTAVYYCARGPYGVWLDYWGQGTLVTVSS | SEQ ID NO: 206 |
| Ab33 | EVQLLESGGGLVQPGGSLRLSCAASGFTFSSYGMHWVRQAPGKGLEWVSDISSNGGTIYYADSVKGRFTISRD NSKNTLYLQMNSLRAEDTAVYYCARGPYGVWLDYWGQGTLVTVSS | SEQ ID NO: 207 |
| Ab42 | EVQLLESGGGLVQPGGSLRLSCAASGFTFSSYGMHWVRQAPGKGLEWVARINSNGGSKSYADSVKGRFTISRD NSKNTLYLQMNSLRAEDTAVYYCARGPYGYWFDYWGQGTLVTVSS | SEQ ID NO: 208 |
| Ab45 | EVQLLESGGGLVQPGGSLRLSCAASGFTFSSYGMNWVRQAPGKGLEWVARISSSGSYIGYADSVKGRFTISRD NSKNTLYLQMNSLRAEDTAVYYCARGPYGYWLDYWGQGTLVTVSS | SEQ ID NO: 209 |

FIG. 2J (ARG) VL

| clone | VL | SEQ ID NOs. |
|---|---|---|
| Ab2 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 210 |
| Ab47 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 211 |
| Ab49 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 212 |
| Ab31 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 213 |
| Ab53 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 214 |
| Ab40 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 215 |
| Ab5 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 216 |
| Ab9 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 217 |
| Ab48 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 218 |
| Ab4 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 219 |
| Ab10 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 220 |
| Ab37 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 221 |
| Ab33 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 222 |
| Ab42 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 223 |
| Ab45 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 224 |

FIG. 2K
(ARV) VH

| clone | Vh | SEQ ID NOs. |
|---|---|---|
| Ab44 | EVQLLESGGGLVQPGGSLRLSCAASGFTFSSYSMHWVRQAPGKGLEWVSAISSDGSYISYADSVKGRFTISRDNSKNTLYLQMNSLRAEDTAVYYCARVPYDVWFDYWGQGTLVTVSS | SEQ ID NO: 225 |
| Ab97 | EVQLLESGGGLVQPGGSLRLSCAASGFTFSSYSMHWVRQAPGKGLEWVAAISSNTGSIGYADSVKGRFTISRDNSKNTLYLQMNSLRAEDTAVYYCARVPYDVWIDYWGQGTLVTVSS | SEQ ID NO: 226 |
| Ab81 | EVQLLESGGGLVQPGGSLRLSCAASGFTFSSYSMHWVRQAPGKGLEWVASIKGNTGSSGYADSVKGRFTISRDNSKNTLYLQMNSLRAEDTAVYYCARVPYDVWIDYWGQGTLVTVSS | SEQ ID NO: 227 |
| Ab188 | EVQLLESGGGLVQPGGSLRLSCAASGFTFSSYSMHWVRQAPGKGLEWVASIKSNAGTSSYADSVKGRFTISRDNSKNTLYLQMNSLRAEDTAVYYCARVPYDVWIDYWGQGTLVTVSS | SEQ ID NO: 228 |
| Ab186 | EVQLLESGGGLVQPGGSLRLSCAASGFTFSSYSMHWVRQAPGKGLEWVASISSNAGYSSYADSVKGRFTISRDNSKNTLYLQMNSLRAEDTAVYYCARVPYDVWIDYWGQGTLVTVSS | SEQ ID NO: 229 |
| Ab62 | EVQLLESGGGLVQPGGSLRLSCAASGFTFSSYSMSWVRQAPGKGLEWVASISSSAGYSYYADSVKGRFTISRDNSKNTLYLQMNSLRAEDTAVYYCARVPYDVWIDYWGQGTLVTVSS | SEQ ID NO: 230 |
| Ab57 | EVQLLESGGGLVQPGGSLRLSCAASGFTFSSYSMHWVRQAPGKGLEWVAYIKSDTSTIGYADSVKGRFTISRDNSKNTLYLQMNSLRAEDTAVYYCARVPYDVWIDYWGQGTLVTVSS | SEQ ID NO: 231 |
| Ab192 | EVQLLESGGGLVQPGGSLRLSCAASGFTFSSYAMHWVRQAPGKGLEWVSSISSDTGYIGYADSVKGRFTISRDNSKNTLYLQMNSLRAEDTAVYYCARVPYDVWIDYWGQGTLVTVSS | SEQ ID NO: 232 |
| Ab73 | EVQLLESGGGLVQPGGSLRLSCAASGFTFSSYSMSWVRQAPGKGLEWVASIKGSAGSSSYADSVKGRFTISRDNSKNTLYLQMNSLRAEDTAVYYCARVPYDVWLDYWGQGTLVTVSS | SEQ ID NO: 233 |
| Ab60 | EVQLLESGGGLVQPGGSLRLSCAASGFTFSSYSMHWVRQAPGKGLEWVSSISSSAGYTSYADSVKGRFTISRDNSKNTLYLQMNSLRAEDTAVYYCARVPYDVWLDYWGQGTLVTVSS | SEQ ID NO: 234 |
| Ab28 | EVQLLESGGGLVQPGGSLRLSCAASGFTFSSYSMHWVRQAPGKGLEWVANINSNGGNTGYADSVKGRFTISRDNSKNTLYLQMNSLRAEDTAVYYCARVPYDVWMDYWGQGTLVTVSS | SEQ ID NO: 235 |
| Ab32 | EVQLLESGGGLVQPGGSLRLSCAASGFTFSSYSMHWVRQAPGKGLEWVANINSNGGNTGYADSVKGRFTISRDNSKNTLYLQMNSLRAEDTAVYYCARVPYDVWMDYWGQGTLVTVSS | SEQ ID NO: 236 |
| Ab78 | EVQLLESGGGLVQPGGSLRLSCAASGFTFSSYSMHWVRQAPGKGLEWVASISGSTSSSSYADSVKGRFTISRDNSKNTLYLQMNSLRAEDTAVYYCARVPYDVWMDYWGQGTLVTVSS | SEQ ID NO: 237 |
| Ab14 | EVQLLESGGGLVQPGGSLRLSCAASGFTFSSYGMHWVRQAPGKGLEWVSSISSSGGTKGYADSVKGRFTISRDNSKNTLYLQMNSLRAEDTAVYYCARVPYDVWMDYWGQGTLVTVSS | SEQ ID NO: 238 |
| Ab152 | EVQLLESGGGLVQPGGSLRLSCAASGFTFSSYSMHWVRQAPGKGLEWVTSISSNAGYISYADSVKGRFTISRDNSKNTLYLQMNSLRAEDTAVYYCARVPYDVWMDYWGQGTLVTVSS | SEQ ID NO: 239 |
| Ab72 | EVQLLESGGGLVQPGGSLRLSCAASGFTFSSYSMHWVRQAPGKGLEWVAAIKSDAGTSGYADSVKGRFTISRDNSKNTLYLQMNSLRAEDTAVYYCARVPYDYWIDYWGQGTLVTVSS | SEQ ID NO: 240 |
| Ab137 | EVQLLESGGGLVQPGGSLRLSCAASGFTFSSYSMHWVRQAPGKGLEWVASIKGNTGSISYADSVKGRFTISRDNSKNTLYLQMNSLRAEDTAVYYCARVPYDYWIDYWGQGTLVTVSS | SEQ ID NO: 241 |
| Ab128 | EVQLLESGGGLVQPGGSLRLSCAASGFTFSSYSMNWVRQAPGKGLEWVASIKGSASYTSYADSVKGRFTISRDNSKNTLYLQMNSLRAEDTAVYYCARVPYDYWIDYWGQGTLVTVSS | SEQ ID NO: 242 |
| Ab169 | EVQLLESGGGLVQPGGSLRLSCAASGFTFSSYSMHWVRQAPGKGLEWVASIKSDTSSTYYADSVKGRFTISRDNSKNTLYLQMNSLRAEDTAVYYCARVPYDYWIDYWGQGTLVTVSS | SEQ ID NO: 243 |
| Ab87 | EVQLLESGGGLVQPGGSLRLSCAASGFTFSSYSMSWVRQAPGKGLEWVASIKSSAGYISYADSVKGRFTISRDNSKNTLYLQMNSLRAEDTAVYYCARVPYDYWIDYWGQGTLVTVSS | SEQ ID NO: 244 |
| Ab74 | EVQLLESGGGLVQPGGSLRLSCAASGFTFSSYSMHWVRQAPGKGLEWVASISSNAGTTGYADSVKGRFTISRDNSKNTLYLQMNSLRAEDTAVYYCARVPYDYWIDYWGQGTLVTVSS | SEQ ID NO: 245 |
| Ab172 | EVQLLESGGGLVQPGGSLRLSCAASGFTFSSYSMHWVRQAPGKGLEWVSSIKSSAGYTYYADSVKGRFTISRDNSKNTLYLQMNSLRAEDTAVYYCARVPYDYWIDYWGQGTLVTVSS | SEQ ID NO: 246 |
| Ab153 | EVQLLESGGGLVQPGGSLRLSCAASGFTFSSYSMHWVRQAPGKGLEWVSSINSNAGTISYADSVKGRFTISRDNSKNTLYLQMNSLRAEDTAVYYCARVPYDYWIDYWGQGTLVTVSS | SEQ ID NO: 247 |
| Ab120 | EVQLLESGGGLVQPGGSLRLSCAASGFTFSSYSMNWVRQAPGKGLEWVSSINSNAGTIYYADSVKGRFTISRDNSKNTLYLQMNSLRAEDTAVYYCARVPYDYWIDYWGQGTLVTVSS | SEQ ID NO: 248 |
| Ab13 | EVQLLESGGGLVQPGGSLRLSCAASGFTFDSYSMHWVRQAPGKGLEWVSSINSNGGYKYYADSVKGRFTISRDNSKNTLYLQMNSLRAEDTAVYYCARVPYDYWIDYWGQGTLVTVSS | SEQ ID NO: 249 |
| Ab113 | EVQLLESGGGLVQPGGSLRLSCAASGFTFSSYSMNWVRQAPGKGLEWVTSISSSASTTGYADSVKGRFTISRDNSKNTLYLQMNSLRAEDTAVYYCARVPYDYWIDYWGQGTLVTVSS | SEQ ID NO: 250 |
| Ab16 | EVQLLESGGGLVQPGGSLRLSCAASGFTFSSYSMHWVRQAPGKGLEWVAAIKSSGSSTSYADSVKGRFTISRDNSKNTLYLQMNSLRAEDTAVYYCARVPYDYWLDYWGQGTLVTVSS | SEQ ID NO: 251 |

FIG. 2L (ARV) VH

| clone | Vh | SEQ ID NOs. |
|---|---|---|
| Ab56 | EVQLLESGGGLVQPGGSLRLSCAASGFTFSSYSMSWVRQAPGKGLEWVASINSNAGTISYADSVKGRFTISRDNSKNTLYLQMNSLRAEDTAVYYCARVPYDYWLDYWGQGTLVTVSS | SEQ ID NO: 252 |
| Ab129 | EVQLLESGGGLVQPGGSLRLSCAASGFTFSSYSMHWVRQAPGKGLEWVSSISSSAGTSGYADSVKGRFTISRDNSKNTLYLQMNSLRAEDTAVYYCARVPYDYWLDYWGQGTLVTVSS | SEQ ID NO: 253 |
| Ab50 | EVQLLESGGGLVQPGGSLRLSCAASGFTFSSYSMHWVRQAPGKGLEWVAAIKSNGGYIYYADSVKGRFTISRDNSKNTLYLQMNSLRAEDTAVYYCARVPYDYWMDYWGQGTLVTVSS | SEQ ID NO: 254 |
| Ab90 | EVQLLESGGGLVQPGGSLRLSCAASGFTFSSYAMHWVRQAPGKGLEWVAAISSNTGYIYYADSVKGRFTISRDNSKNTLYLQMNSLRAEDTAVYYCARVPYDYWMDYWGQGTLVTVSS | SEQ ID NO: 255 |
| Ab99 | EVQLLESGGGLVQPGGSLRLSCAASGFTFSSYSMSWVRQAPGKGLEWVAAISSSATTSYADSVKGRFTISRDNSKNTLYLQMNSLRAEDTAVYYCARVPYDYWMDYWGQGTLVTVSS | SEQ ID NO: 256 |
| Ab3 | EVQLLESGGGLVQPGGSLRLSCAASGFTFSDYGMHWVRQAPGKGLEWVAGIWYNGGYKSYADSVKGRFTISRDNSKNTLYLQMNSLRAEDTAVYYCARVPYDYWMDYWGQGTLVTVSS | SEQ ID NO: 257 |
| Ab148 | EVQLLESGGGLVQPGGSLRLSCAASGFTFSSYSMSWVRQAPGKGLEWVASIKGSAGYIYYADSVKGRFTISRDNSKNTLYLQMNSLRAEDTAVYYCARVPYDYWMDYWGQGTLVTVSS | SEQ ID NO: 258 |
| Ab124 | EVQLLESGGGLVQPGGSLRLSCAASGFTFSSYSMHWVRQAPGKGLEWVASIKGSASYSYYADSVKGRFTISRDNSKNTLYLQMNSLRAEDTAVYYCARVPYDYWMDYWGQGTLVTVSS | SEQ ID NO: 259 |
| Ab22 | EVQLLESGGGLVQPGGSLRLSCAASGFTFSSYSMHWVRQAPGKGLEWVASIKSGGGSKYYADSVKGRFTISRDNSKNTLYLQMNSLRAEDTAVYYCARVPYDYWMDYWGQGTLVTVSS | SEQ ID NO: 260 |
| Ab41 | EVQLLESGGGLVQPGGSLRLSCAASGFTFSSYSMHWVRQAPGKGLEWVASIKSGGYISYADSVKGRFTISRDNSKNTLYLQMNSLRAEDTAVYYCARVPYDYWMDYWGQGTLVTVSS | SEQ ID NO: 261 |
| Ab119 | EVQLLESGGGLVQPGGSLRLSCAASGFTFSSYSMSWVRQAPGKGLEWVASIKSSTGTISYADSVKGRFTISRDNSKNTLYLQMNSLRAEDTAVYYCARVPYDYWMDYWGQGTLVTVSS | SEQ ID NO: 262 |
| Ab157 | EVQLLESGGGLVQPGGSLRLSCAASGFTFSSYSMNWVRQAPGKGLEWVASINSNAGSTYYADSVKGRFTISRDNSKNTLYLQMNSLRAEDTAVYYCARVPYDYWMDYWGQGTLVTVSS | SEQ ID NO: 263 |
| Ab27 | EVQLLESGGGLVQPGGSLRLSCAASGFTFSSYSMXWVRQAPGKGLEWVASISSSGGSIYYADSVKGRFTISRDNSKNTLYLQMNSLRAEDTAVYYCARVPYDYWMDYWGQGTLVTVSS | SEQ ID NO: 264 |
| Ab15 | EVQLLESGGGLVQPGGSLRLSCAASGFTFSSYSMHWVRQAPGKGLEWVASIWSNSGNTGYADSVKGRFTISRDNSKNTLYLQMNSLRAEDTAVYYCARVPYDYWMDYWGQGTLVTVSS | SEQ ID NO: 265 |
| Ab191 | EVQLLESGGGLVQPGGSLRLSCAASGFTFSSYSMHWVRQAPGKGLEWVSSIKSSASYSSYADSVKGRFTISRDNSKNTLYLQMNSLRAEDTAVYYCARVPYDYWMDYWGQGTLVTVSS | SEQ ID NO: 266 |
| Ab190 | EVQLLESGGGLVQPGGSLRLSCAASGFTFSSYAMHWVRQAPGKGLEWVAAIKSSAGYSYYADSVKGRFTISRDNSKNTLYLQMNSLRAEDTAVYYCARVPYGVWIDYWGQGTLVTVSS | SEQ ID NO: 267 |
| Ab79 | EVQLLESGGGLVQPGGSLRLSCAASGFTFSSYAMHWVRQAPGKGLEWVADIKSNTGYTYYADSVKGRFTISRDNSKNTLYLQMNSLRAEDTAVYYCARVPYGVWIDYWGQGTLVTVSS | SEQ ID NO: 268 |
| Ab181 | EVQLLESGGGLVQPGGSLRLSCAASGFTFSSYAMSWVRQAPGKGLEWVASIKSSTGYTYYADSVKGRFTISRDNSKNTLYLQMNSLRAEDTAVYYCARVPYGVWIDYWGQGTLVTVSS | SEQ ID NO: 269 |
| Ab146 | EVQLLESGGGLVQPGGSLRLSCAASGFTFSSYAMHWVRQAPGKGLEWVASISGNAGSSSYADSVKGRFTISRDNSKNTLYLQMNSLRAEDTAVYYCARVPYGVWIDYWGQGTLVTVSS | SEQ ID NO: 270 |
| Ab167 | EVQLLESGGGLVQPGGSLRLSCAASGFTFSSYAMHWVRQAPGKGLEWVASISGNAGSSSYADSVKGRFTISRDNSKNTLYLQMNSLRAEDTAVYYCARVPYGVWIDYWGQGTLVTVSS | SEQ ID NO: 271 |
| Ab88 | EVQLLESGGGLVQPGGSLRLSCAASGFTFSSYSMSWVRQAPGKGLEWVASISSSAGTTSYADSVKGRFTISRDNSKNTLYLQMNSLRAEDTAVYYCARVPYGVWIDYWGQGTLVTVSS | SEQ ID NO: 272 |
| Ab199 | EVQLLESGGGLVQPGGSLRLSCAASGFTFSSYSMHWVRQAPGKGLEWVASISSSASTSGYADSVKGRFTISRDNSKNTLYLQMNSLRAEDTAVYYCARVPYGVWIDYWGQGTLVTVSS | SEQ ID NO: 273 |
| Ab71 | EVQLLESGGGLVQPGGSLRLSCAASGFTFSSYSMHWVRQAPGKGLEWVASISSSASTSYYADSVKGRFTISRDNSKNTLYLQMNSLRAEDTAVYYCARVPYGVWIDYWGQGTLVTVSS | SEQ ID NO: 274 |
| Ab85 | EVQLLESGGGLVQPGGSLRLSCAASGFTFSSYAMSWVRQAPGKGLEWVAISGSGGSTYYADSVKGRFTISRDNSKNTLYLQMNSLRAEDTAVYYCARVPYGVWIDYWGQGTLVTVSS | SEQ ID NO: 275 |
| Ab59 | EVQLLESGGGLVQPGGSLRLSCAASGFTFSSYAMNWVRQAPGKGLEWVAAISGNAGSSSYADSVKGRFTISRDNSKNTLYLQMNSLRAEDTAVYYCARVPYGVWLDYWGQGTLVTVSS | SEQ ID NO: 276 |
| Ab141 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARVPYGVWLDYWGQGTLVTVSS | SEQ ID NO: 277 |
| Ab68 | EVQLLESGGGLVQPGGSLRLSCAASGFTFSSYSMHWVRQAPGKGLEWVAAIKGNTGSTYYADSVKGRFTISRDNSKNTLYLQMNSLRAEDTAVYYCARVPYGVWMDYWGQGTLVTVSS | SEQ ID NO: 278 |

FIG. 2M (ARV) VH

| clone | Vh | SEQ ID NOs. |
|---|---|---|
| Ab143 | EVQLLESGGGLVQPGGSLRLSCAASGFTFSSYSMHWVRQAPGKGLEWVAAINSNAGSSSYADSVKGRFTISRDNSKNTLYLQMNSLRAEDTAVYYCARVPYGVWMDYWGQGTLVTVSS | SEQ ID NO: 279 |
| Ab46 | EVQLLESGGGLVQPGGSLRLSCAASGFTFSSYSMHWVRQAPGKGLEWVAGIWSSGGTTSYADSVKGRFTISRDNSKNTLYLQMNSLRAEDTAVYYCARVPYGVWMDYWGQGTLVTVSS | SEQ ID NO: 280 |
| Ab197 | EVQLLESGGGLVQPGGSLRLSCAASGFTFSSYSMHWVRQAPGKGLEWVAYIKGSAGSTSYADSVKGRFTISRDNSKNTLYLQMNSLRAEDTAVYYCARVPYGVWMDYWGQGTLVTVSS | SEQ ID NO: 281 |
| Ab175 | EVQLLESGGGLVQPGGSLRLSCAASGFTFSSYSMHWVRQAPGKGLEWVSAINSNAGSSSYADSVKGRFTISRDNSKNTLYLQMNSLRAEDTAVYYCARVPYGVWMDYWGQGTLVTVSS | SEQ ID NO: 282 |
| Ab156 | EVQLLESGGGLVQPGGSLRLSCAASGFTFSSYAMSWVRQAPGKGLEWVSYISGNAGYISYADSVKGRFTISRDNSKNTLYLQMNSLRAEDTAVYYCARVPYGVWMDYWGQGTLVTVSS | SEQ ID NO: 283 |
| Ab63 | EVQLLESGGGLVQPGGSLRLSCAASGFTFSSYSMHWVRQAPGKGLEWVASISGSTGTSYYADSVKGRFTISRDNSKNTLYLQMNSLRAEDTAVYYCARVPYGYWIDYWGQGTLVTVSS | SEQ ID NO: 284 |
| Ab11 | EVQLLESGGGLVQPGGSLRLSCAASGFTFSSYGMHWVRQAPGKGLEWVASISSNGGYTSYADSVKGRFTISRDNSKNTLYLQMNSLRAEDTAVYYCARVPYGYWIDYWGQGTLVTVSS | SEQ ID NO: 285 |
| Ab182 | EVQLLESGGGLVQPGGSLRLSCAASGFTFSSYSMHWVRQAPGKGLEWVASISSNTGTTGYADSVKGRFTISRDNSKNTLYLQMNSLRAEDTAVYYCARVPYGYWIDYWGQGTLVTVSS | SEQ ID NO: 286 |
| Ab89 | EVQLLESGGGLVQPGGSLRLSCAASGFTFSSYAMHWVRQAPGKGLEWVTSISSSTGYISYADSVKGRFTISRDNSKNTLYLQMNSLRAEDTAVYYCARVPYGYWIDYWGQGTLVTVSS | SEQ ID NO: 287 |
| Ab8 | EVQLLESGGGLVQPGGSLRLSCAASGFTFSSYAMSWVRQAPGKGLEWVADIKSNGGYTYYADSVKGRFTISRDNSKNTLYLQMNSLRAEDTAVYYCARVPYGYWLDYWGQGTLVTVSS | SEQ ID NO: 288 |
| Ab101 | EVQLLESGGGLVQPGGSLRLSCAASGFTFSSYAMSWVRQAPGKGLEWVADISGSAGTISYADSVKGRFTISRDNSKNTLYLQMNSLRAEDTAVYYCARVPYGYWLDYWGQGTLVTVSS | SEQ ID NO: 289 |
| Ab25 | EVQLLESGGGLVQPGGSLRLSCAASGFTFSSYGMHWVRQAPGKGLEWVAAIKSSGSSTSYADSVKGRFTISRDNSKNTLYLQMNSLRAEDTAVYYCARVPYGYWMDYWGQGTLVTVSS | SEQ ID NO: 290 |
| Ab154 | EVQLLESGGGLVQPGGSLRLSCAASGFTFSSYSMHWVRQAPGKGLEWVASIKSNTGTTGYADSVKGRFTISRDNSKNTLYLQMNSLRAEDTAVYYCARVPYGYWMDYWGQGTLVTVSS | SEQ ID NO: 291 |
| Ab21 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARVPYGYWMDYWGQGTLVTVSS | SEQ ID NO: 292 |
| Ab111 | EVQLLESGGGLVQPGGSLRLSCAASGFTFSSYSMHWVRQAPGKGLEWVSAISGSGGSTYYADSVKGRFTISRDNSKNTLYLQMNSLRAEDTAVYYCARVPYGYWMDYWGQGTLVTVSS | SEQ ID NO: 293 |
| Ab118 | EVQLLESGGGLVQPGGSLRLSCAASGFTFSSYAMSWVRQAPGKGLEWVSSINSNAGTSYYADSVKGRFTISRDNSKNTLYLQMNSLRAEDTAVYYCARVPYGYWMDYWGQGTLVTVSS | SEQ ID NO: 294 |
| Ab173 | EVQLLESGGGLVQPGGSLRLSCAASGFTFSSYAMSWVRQAPGKGLEWVSSISSNTGTISYADSVKGRFTISRDNSKNTLYLQMNSLRAEDTAVYYCARVPYGYWMDYWGQGTLVTVSS | SEQ ID NO: 295 |
| Ab38 | EVQLLESGGGLVQPGGSLRLSCAASGFTFSSYTMSWVRQAPGKGLEWVAGIWSDSGNKGYADSVKGRFTISRDNSKNTLYLQMNSLRAEDTAVYYCARVPYSVWIDYWGQGTLVTVSS | SEQ ID NO: 296 |
| Ab76 | EVQLLESGGGLVQPGGSLRLSCAASGFTFDSYSMHWVRQAPGKGLEWVSAISGSGGSTYYADSVKGRFTISRDNSKNTLYLQMNSLRAEDTAVYYCARVPYSVWIDYWGQGTLVTVSS | SEQ ID NO: 297 |
| Ab131 | EVQLLESGGGLVQPGGSLRLSCAASGFTFSSYAMSWVRQAPGKGLEWVSDIKSSAGSTSYADSVKGRFTISRDNSKNTLYLQMNSLRAEDTAVYYCARVPYSVWIDYWGQGTLVTVSS | SEQ ID NO: 298 |
| Ab1 | EVQLLESGGGLVQPGGSLRLSCAASGFTFSSYAMHWVRQAPGKGLEWVSGISSNGGSTSYADSVKGRFTISRDNSKNTLYLQMNSLRAEDTAVYYCARVPYSVWIDYWGQGTLVTVSS | SEQ ID NO: 299 |
| Ab67 | EVQLLESGGGLVQPGGSLRLSCAASGFTFSSYAMSWVRQAPGKGLEWVASIKSSTGTTYYADSVKGRFTISRDNSKNTLYLQMNSLRAEDTAVYYCARVPYSVWLDYWGQGTLVTVSS | SEQ ID NO: 300 |
| Ab70 | EVQLLESGGGLVQPGGSLRLSCAASGFTFSSYAMNWVRQAPGKGLEWVASISSNTGTIGYADSVKGRFTISRDNSKNTLYLQMNSLRAEDTAVYYCARVPYSVWLDYWGQGTLVTVSS | SEQ ID NO: 301 |
| Ab170 | EVQLLESGGGLVQPGGSLRLSCAASGFTFNSYAMHWVRQAPGKGLEWVAYISGNAGSIYYADSVKGRFTISRDNSKNTLYLQMNSLRAEDTAVYYCARVPYSVWLDYWGQGTLVTVSS | SEQ ID NO: 302 |
| Ab30 | EVQLLESGGGLVQPGGSLRLSCAASGFTFSSYGMHWVRQAPGKGLEWVASIKSNSGNTGYADSVKGRFTISRDNSKNTLYLQMNSLRAEDTAVYYCARVPYSVWMDYWGQGTLVTVSS | SEQ ID NO: 303 |
| Ab93 | EVQLLESGGGLVQPGGSLRLSCAASGFTFSSYAMSWVRQAPGKGLEWVASISSSTGTISYADSVKGRFTISRDNSKNTLYLQMNSLRAEDTAVYYCARVPYSVWMDYWGQGTLVTVSS | SEQ ID NO: 304 |
| Ab142 | EVQLLESGGGLVQPGGSLRLSCAASGFTFSSYSMHWVRQAPGKGLEWVSAISGSGGSTYYADSVKGRFTISRDNSKNTLYLQMNSLRAEDTAVYYCARVPYSVWMDYWGQGTLVTVSS | SEQ ID NO: 305 |

FIG. 2N (ARV) VH

| clone | Vh | SEQ ID NOs. |
|---|---|---|
| Ab104 | EVQLLESGGGLVQPGGSLRLSCAASGFTFSSYAMSWVRQAPGKGLEWVSSISSSASYTGYADSVKGRFTISRDNSKNTLYLQMNSLRAEDTAVYYCARVPYSYWIDYWGQGTLVTVSS | SEQ ID NO: 306 |
| Ab112 | EVQLLESGGGLVQPGGSLRLSCAASGFTFSSYAMSWVRQAPGKGLEWVASISSNTGSIYYADSVKGRFTISRDNSKNTLYLQMNSLRAEDTAVYYCARVPYSYWLDYWGQGTLVTVSS | SEQ ID NO: 307 |
| Ab35 | EVQLLESGGGLVQPGGSLRLSCAASGFTFSSYGMHWVRQAPGKGLEWVASISSSSGYKYYADSVKGRFTISRDNSKNTLYLQMNSLRAEDTAVYYCARVPYSYWMDYWGQGTLVTVSS | SEQ ID NO: 308 |
| Ab126 | EVQLLESGGGLVQPGGSLRLSCAASGFTFSSYAMHWVRQAPGKGLEWVASISSSTGSIGYADSVKGRFTISRDNSKNTLYLQMNSLRAEDTAVYYCARVPYSYWMDYWGQGTLVTVSS | SEQ ID NO: 309 |
| Ab125 | EVQLLESGGGLVQPGGSLRLSCAASGFTFSSYSMHWVRQAPGKGLEWVASIKGNAGTTYYADSVKGRFTISRDNSKNTLYLQMNSLRAEDTAVYYCARVPYDVWMDYWGQGTLVTVSS | SEQ ID NO: 310 |

FIG. 20

(ARV) VL

| clone | VL | SEQ ID NOs. |
|---|---|---|
| Ab44 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 311 |
| Ab97 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 312 |
| Ab81 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 313 |
| Ab188 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 314 |
| Ab186 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 315 |
| Ab62 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 316 |
| Ab57 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 317 |
| Ab192 | DIQMTQSPSSLSASVGDRVTITCRASQSISYYVNWYQQKPGKAPKLLIYAASSLQSGVPSRFSGSGSGTDFTLTISSLQPEDFATYYCQQSYSTPLTFGGGTKVEIK | SEQ ID NO: 318 |
| Ab73 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 319 |
| Ab60 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 320 |
| Ab28 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 321 |
| Ab32 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 322 |
| Ab78 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 323 |
| Ab14 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 324 |
| Ab152 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 325 |
| Ab72 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 326 |
| Ab137 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 327 |
| Ab128 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 328 |
| Ab169 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 329 |
| Ab87 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 330 |
| Ab74 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 331 |
| Ab172 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 332 |
| Ab153 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 333 |
| Ab120 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 334 |
| Ab13 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 335 |
| Ab113 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 336 |
| Ab16 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 337 |

FIG. 2P (ARV) VL

| clone | VL | SEQ ID NOs. |
|---|---|---|
| Ab56 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 338 |
| Ab129 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 339 |
| Ab50 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 340 |
| Ab90 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 341 |
| Ab99 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 342 |
| Ab3 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 343 |
| Ab148 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 344 |
| Ab124 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 345 |
| Ab22 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 346 |
| Ab41 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 347 |
| Ab119 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 348 |
| Ab157 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 349 |
| Ab27 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 350 |
| Ab15 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 351 |
| Ab191 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 352 |
| Ab190 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 353 |
| Ab79 | DIQMTQSPSSLSASVGDRVTITCRASQSISYYANWYQQKPGKAPKLLIYAASSLQSGVPSRFSGSGSGTDFTLTISSLQPEDFATYYCQQSYSTPLTFGGGTKVEIK | SEQ ID NO: 354 |
| Ab181 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 355 |
| Ab146 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 356 |
| Ab167 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 357 |
| Ab88 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 358 |
| Ab199 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 359 |
| Ab71 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 360 |
| Ab85 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 361 |
| Ab59 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 362 |
| Ab141 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 363 |
| Ab68 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 364 |

FIG. 2Q

| clone | (ARV) VL<br>VL | SEQ ID NOs. |
|---|---|---|
| Ab143 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 365 |
| Ab46 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 366 |
| Ab197 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 367 |
| Ab175 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 368 |
| Ab156 | DIQMTQSPSSLSASVGDRVTITCRASQSISSYAAWYQQKPGKAPKLLIYGNTSRQSGVPSRFSGSGSGTDFTLTISSLQPEDFATYYCQQYSNSPLTFGGGTKVEIK | SEQ ID NO: 369 |
| Ab63 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 370 |
| Ab11 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 371 |
| Ab182 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 372 |
| Ab89 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 373 |
| Ab8 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 374 |
| Ab101 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 375 |
| Ab25 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 376 |
| Ab154 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 377 |
| Ab21 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 378 |
| Ab111 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 379 |
| Ab118 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 380 |
| Ab173 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 381 |
| Ab38 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 382 |
| Ab76 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 383 |
| Ab131 | DIQMTQSPSSLSASVGDRVTITCRASQSISYVNWYQQKPGKAPKLLIYAASSLQSGVPSRFSGSGSGTDFTLTISSLQPEDFATYYCQQSYSTPLTFGGGTKVEIK | SEQ ID NO: 384 |
| Ab1 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 385 |
| Ab67 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 386 |
| Ab70 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 387 |
| Ab170 | DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK | SEQ ID NO: 388 |
| Ab30 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 389 |
| Ab93 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 390 |
| Ab142 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 391 |

FIG. 2R (ARV) VL

| clone | VL | SEQ ID NOs. |
|---|---|---|
| Ab104 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 392 |
| Ab112 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 393 |
| Ab35 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 394 |
| Ab126 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 395 |
| Ab125 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | SEQ ID NO: 396 |

FIG. 3A
(ARE) CDRs

| clone | HCDR1 | HCDR2 | HCDR3 | LCDR1 | LCDR2 | LCDR3 |
|---|---|---|---|---|---|---|
| Ab58 | SSYAMS SEQ ID NO: 397 | WVSSIKSSAGSSY SEQ ID NO: 398 | AREPYDVWID SEQ ID NO: 399 | SYYLNWY SEQ ID NO: 400 | LLIYAASSLQ SEQ ID NO: 401 | QQSYSTPL SEQ ID NO: 402 |
| Ab69 | SSYSMS SEQ ID NO: 403 | WVAAIKGSTSSSY SEQ ID NO: 404 | AREPYDVWLD SEQ ID NO: 405 | SSYLNWY SEQ ID NO: 406 | LLIYAASSLQ SEQ ID NO: 407 | QQSYSTPL SEQ ID NO: 408 |
| Ab75 | SSYSMS SEQ ID NO: 409 | WVAAIKSNAGTSS SEQ ID NO: 410 | AREPYDVWLD SEQ ID NO: 411 | SSYLNWY SEQ ID NO: 412 | LLIYAASSLQ SEQ ID NO: 413 | QQSYSTPL SEQ ID NO: 414 |
| Ab133 | SSYAMS SEQ ID NO: 415 | WVSSISSNTGSIS SEQ ID NO: 416 | AREPYDVWLD SEQ ID NO: 417 | SSYLNWY SEQ ID NO: 418 | LLIYAASSLQ SEQ ID NO: 419 | QQSYSTPL SEQ ID NO: 420 |
| Ab177 | SSYSMS SEQ ID NO: 421 | WVADISSSASTIG SEQ ID NO: 422 | AREPYDVWMD SEQ ID NO: 423 | SYYLNWY SEQ ID NO: 424 | LLIYAASSLQ SEQ ID NO: 425 | QQSYSTPL SEQ ID NO: 426 |
| Ab122 | SSYSMS SEQ ID NO: 427 | WVSAISGSGGSTY SEQ ID NO: 428 | AREPYDVWMD SEQ ID NO: 429 | SSYLNWY SEQ ID NO: 430 | LLIYAASSLQ SEQ ID NO: 431 | QQSYSTPL SEQ ID NO: 432 |
| Ab86 | SSYSMS SEQ ID NO: 433 | WVSSISSNTGTSY SEQ ID NO: 434 | AREPYDVWMD SEQ ID NO: 435 | SSYLNWY SEQ ID NO: 436 | LLIYAASSLQ SEQ ID NO: 437 | QQSYSTPL SEQ ID NO: 438 |
| Ab180 | SSYSMS SEQ ID NO: 439 | WVSSISSNTGTSY SEQ ID NO: 440 | AREPYDVWMD SEQ ID NO: 441 | SSYLNWY SEQ ID NO: 442 | LLIYAASSLQ SEQ ID NO: 443 | QQSYSTPL SEQ ID NO: 444 |
| Ab83 | SSYSMS SEQ ID NO: 445 | WVAAISGSAGTSG SEQ ID NO: 446 | AREPYDYWLD SEQ ID NO: 447 | SSYLNWY SEQ ID NO: 448 | LLIYAASSLQ SEQ ID NO: 449 | QQSYSTPL SEQ ID NO: 450 |
| Ab26 | SSYSMS SEQ ID NO: 451 | WVADIKSSGSTKS SEQ ID NO: 452 | AREPYDYWMD SEQ ID NO: 453 | SSYLNWY SEQ ID NO: 454 | LLIYAASSLQ SEQ ID NO: 455 | QQSYSTPL SEQ ID NO: 456 |
| Ab20 | SSYAMS SEQ ID NO: 457 | WVSAISGSGGSTY SEQ ID NO: 458 | AREPYDYWMD SEQ ID NO: 459 | SSYLNWY SEQ ID NO: 460 | LLIYAASSLQ SEQ ID NO: 461 | QQSYSTPL SEQ ID NO: 462 |
| Ab147 | SSYAMS SEQ ID NO: 463 | WVSAISGSGGSTY SEQ ID NO: 464 | AREPYDYWMD SEQ ID NO: 465 | SSYLNWY SEQ ID NO: 466 | LLIYAASSLQ SEQ ID NO: 467 | QQSYSTPL SEQ ID NO: 468 |
| Ab12 | SSYAMS SEQ ID NO: 469 | WVASINSNGGYKS SEQ ID NO: 470 | AREPYGTWLD SEQ ID NO: 471 | SSYLNWY SEQ ID NO: 472 | LLIYAASSLQ SEQ ID NO: 473 | QQSYSTPL SEQ ID NO: 474 |
| Ab66 | SSYAMS SEQ ID NO: 475 | WVSAISGSGGSTY SEQ ID NO: 476 | AREPYGVWID SEQ ID NO: 477 | SYYLNWY SEQ ID NO: 478 | LLIYAASSLQ SEQ ID NO: 479 | QQSYSTPL SEQ ID NO: 480 |
| Ab176 | SSYSMN SEQ ID NO: 481 | WVASIKGSASTIY SEQ ID NO: 482 | AREPYGVWLD SEQ ID NO: 483 | SYYVNWF SEQ ID NO: 484 | LLIYAASSLQ SEQ ID NO: 485 | QQSYSTPL SEQ ID NO: 486 |
| Ab96 | SSYAMS SEQ ID NO: 487 | WVASIKSNTGSSS SEQ ID NO: 488 | AREPYGVWLD SEQ ID NO: 489 | SSYLNWY SEQ ID NO: 490 | LLIYAASSLQ SEQ ID NO: 491 | QQSYSTPL SEQ ID NO: 492 |
| Ab123 | SSYSMS SEQ ID NO: 493 | WVASISSSAGTSS SEQ ID NO: 494 | AREPYGVWLD SEQ ID NO: 495 | SSYLNWY SEQ ID NO: 496 | LLIYAASSLQ SEQ ID NO: 497 | QQSYSTPL SEQ ID NO: 498 |
| Ab109 | SSYAMS | WVAYINSNTGTIY | AREPYGVWLD | SSYLNWY | LLIYAASSLQ | QQSYSTPL |

FIG. 3B (ARE) CDRs

| clone | HCDR1 | HCDR2 | HCDR3 | LCDR1 | LCDR2 | LCDR3 |
|---|---|---|---|---|---|---|
|  | SEQ ID NO: 499 | SEQ ID NO: 500 | SEQ ID NO: 501 | SEQ ID NO: 502 | SEQ ID NO: 503 | SEQ ID NO: 504 |
| Ab149 | SSYAMS SEQ ID NO: 505 | WVAYISGNTGYIG SEQ ID NO: 506 | AREPYGVWLD SEQ ID NO: 507 | SSYANWY SEQ ID NO: 508 | LVIYGNSSRE SEQ ID NO: 509 | QQSGDSNL SEQ ID NO: 510 |
| Ab34 | SSYAMS SEQ ID NO: 511 | WVSAISGSGGSTY SEQ ID NO: 512 | AREPYGVWLD SEQ ID NO: 513 | SSYLNWY SEQ ID NO: 514 | LLIYAASSLQ SEQ ID NO: 515 | QQSYSTPL SEQ ID NO: 516 |
| Ab61 | SSYAMS SEQ ID NO: 517 | WVSAISGSGGSTY SEQ ID NO: 518 | AREPYGVWLD SEQ ID NO: 519 | SSYLNWY SEQ ID NO: 520 | LLIYAASSLQ SEQ ID NO: 521 | QQSYSTPL SEQ ID NO: 522 |
| Ab64 | SSYSMS SEQ ID NO: 523 | WVSAISSNAGSTS SEQ ID NO: 524 | AREPYGVWLD SEQ ID NO: 525 | SSYLNWY SEQ ID NO: 526 | LLIYAASSLQ SEQ ID NO: 527 | QQSYSTPL SEQ ID NO: 528 |
| Ab105 | SSYSMS SEQ ID NO: 529 | WVSSINSNAGTTY SEQ ID NO: 530 | AREPYGVWLD SEQ ID NO: 531 | SSYLNWY SEQ ID NO: 532 | LLIYAASSLQ SEQ ID NO: 533 | QQSYSTPL SEQ ID NO: 534 |
| Ab108 | SSYSMS SEQ ID NO: 535 | WVSSINSNAGTTY SEQ ID NO: 536 | AREPYGVWLD SEQ ID NO: 537 | SSYLNWY SEQ ID NO: 538 | LLIYAASSLQ SEQ ID NO: 539 | QQSYSTPL SEQ ID NO: 540 |
| Ab178 | DSYSMN SEQ ID NO: 541 | WVAAIKSDASTIG SEQ ID NO: 542 | AREPYGVWMD SEQ ID NO: 543 | SYYVNWY SEQ ID NO: 544 | LLIYAASSLQ SEQ ID NO: 545 | QQSYSTPL SEQ ID NO: 546 |
| Ab166 | SSYSMN SEQ ID NO: 547 | WVAAISGSTGTIS SEQ ID NO: 548 | AREPYGVWMD SEQ ID NO: 549 | SYYLNWY SEQ ID NO: 550 | LLIYAASSLQ SEQ ID NO: 551 | QQSYSTPL SEQ ID NO: 552 |
| Ab29 | SSYGMN SEQ ID NO: 553 | WVANINSNSGSIY SEQ ID NO: 554 | AREPYGVWMD SEQ ID NO: 555 | SSYLNWY SEQ ID NO: 556 | LLIYAASSLQ SEQ ID NO: 557 | QQSYSTPL SEQ ID NO: 558 |
| Ab135 | DSYAMN SEQ ID NO: 559 | WVASINSNTGSIY SEQ ID NO: 560 | AREPYGVWMD SEQ ID NO: 561 | SYYANWY SEQ ID NO: 562 | LLIYAASSLQ SEQ ID NO: 563 | QQSYSTPL SEQ ID NO: 564 |
| Ab171 | DSYAMN SEQ ID NO: 565 | WVASINSNTGSIY SEQ ID NO: 566 | AREPYGVWMD SEQ ID NO: 567 | SYYANWY SEQ ID NO: 568 | LLIYAASSLQ SEQ ID NO: 569 | QQSYSTPL SEQ ID NO: 570 |
| Ab194 | SSYSMS SEQ ID NO: 571 | WVSAINGNAGSIG SEQ ID NO: 572 | AREPYGVWMD SEQ ID NO: 573 | SYYLNWY SEQ ID NO: 574 | LLIYAASSLQ SEQ ID NO: 575 | QQSYSTPL SEQ ID NO: 576 |
| Ab184 | SSYAMS SEQ ID NO: 577 | WVSAISGSGGSTY SEQ ID NO: 578 | AREPYGVWMD SEQ ID NO: 579 | SYYLNWY SEQ ID NO: 580 | LLIYAASSLQ SEQ ID NO: 581 | QQSYSTPL SEQ ID NO: 582 |
| Ab164 | SSYAMS SEQ ID NO: 583 | WVSYINSNTGSIG SEQ ID NO: 584 | AREPYGVWMD SEQ ID NO: 585 | SYYLNWY SEQ ID NO: 586 | LLIYAASSLQ SEQ ID NO: 587 | QQSYSTPL SEQ ID NO: 588 |
| Ab183 | SSYAMS SEQ ID NO: 589 | WVSYINSNTGSIG SEQ ID NO: 590 | AREPYGVWMD SEQ ID NO: 591 | SYYLNWY SEQ ID NO: 592 | LLIYAASSLQ SEQ ID NO: 593 | QQSYSTPL SEQ ID NO: 594 |
| Ab158 | SSYSMS SEQ ID NO: 595 | WVAAIKGSAGTSG SEQ ID NO: 596 | AREPYGYWLD SEQ ID NO: 597 | SSYVAWY SEQ ID NO: 598 | LLIYGNTSLQ SEQ ID NO: 599 | QQGDENPL SEQ ID NO: 600 |
| Ab55 | SSYAMS SEQ ID NO: 601 | WVASISGNTGTSS SEQ ID NO: 602 | AREPYGYWLD SEQ ID NO: 603 | SSYLNWY SEQ ID NO: 604 | LLIYAASSLQ SEQ ID NO: 605 | QQSYSTPL SEQ ID NO: 606 |
| Ab136 | SSYAMS | WVSAISGSGGSTY | AREPYGYWLD | SSYLNWY | LLIYAASSLQ | QQSYSTPL |

FIG. 3C (ARE) CDRs

| clone | HCDR1 | HCDR2 | HCDR3 | LCDR1 | LCDR2 | LCDR3 |
|---|---|---|---|---|---|---|
| | SEQ ID NO: 607 | SEQ ID NO: 608 | SEQ ID NO: 609 | SEQ ID NO: 610 | SEQ ID NO: 611 | SEQ ID NO: 612 |
| Ab39 | SSYAMS SEQ ID NO: 613 | WVSSIWSNGGSIY SEQ ID NO: 614 | AREPYGYWLD SEQ ID NO: 615 | SSYLNWY SEQ ID NO: 616 | LLIYAASSLQ SEQ ID NO: 617 | QQSYSTPL SEQ ID NO: 618 |
| Ab159 | SSYSMN SEQ ID NO: 619 | WVASIKSSTGTTG SEQ ID NO: 620 | AREPYGYWMD SEQ ID NO: 621 | SSYLNWY SEQ ID NO: 622 | LLIYAASSLQ SEQ ID NO: 623 | QQSYSTPL SEQ ID NO: 624 |
| Ab151 | SSYAMS SEQ ID NO: 625 | WVASIKSSTGYIS SEQ ID NO: 626 | AREPYGYWMD SEQ ID NO: 627 | SSYLNWY SEQ ID NO: 628 | LLIYAASSLQ SEQ ID NO: 629 | QQSYSTPL SEQ ID NO: 630 |
| Ab139 | SSYSMS SEQ ID NO: 631 | WVASISGSASYSY SEQ ID NO: 632 | AREPYGYWMD SEQ ID NO: 633 | SSYLNWY SEQ ID NO: 634 | LLIYAASSLQ SEQ ID NO: 635 | QQSYSTPL SEQ ID NO: 636 |
| Ab107 | SSYSMS SEQ ID NO: 637 | WVSDIKSSAGSTY SEQ ID NO: 638 | AREPYGYWMD SEQ ID NO: 639 | SSYLNWY SEQ ID NO: 640 | LLIYAASSLQ SEQ ID NO: 641 | QQSYSTPL SEQ ID NO: 642 |
| Ab36 | SSYAMS SEQ ID NO: 643 | WVASIKSSGSYKS SEQ ID NO: 644 | AREPYSTWLD SEQ ID NO: 645 | SSYLNWY SEQ ID NO: 646 | LLIYAASSLQ SEQ ID NO: 647 | QQSYSTPL SEQ ID NO: 648 |
| Ab193 | SSYAMS SEQ ID NO: 649 | WVSAIKSDTSTIY SEQ ID NO: 650 | AREPYSTWLD SEQ ID NO: 651 | SYYLNWY SEQ ID NO: 652 | LLIYAASSLQ SEQ ID NO: 653 | QQSYSTPL SEQ ID NO: 654 |
| Ab115 | SSYAMS SEQ ID NO: 655 | WVAAIKGNAGSTS SEQ ID NO: 656 | AREPYSTWMD SEQ ID NO: 657 | SSYLNWY SEQ ID NO: 658 | LLIYAASSLQ SEQ ID NO: 659 | QQSYSTPL SEQ ID NO: 660 |
| Ab106 | SSYAMN SEQ ID NO: 661 | WVASIKSSTGTIS SEQ ID NO: 662 | AREPYSVWID SEQ ID NO: 663 | SSYLNWY SEQ ID NO: 664 | LLIYAASSLQ SEQ ID NO: 665 | QQSYSTPL SEQ ID NO: 666 |
| Ab138 | SSYAMS SEQ ID NO: 667 | WVASIKSSTGTTG SEQ ID NO: 668 | AREPYSVWID SEQ ID NO: 669 | SSYLNWY SEQ ID NO: 670 | LLIYAASSLQ SEQ ID NO: 671 | QQSYSTPL SEQ ID NO: 672 |
| Ab127 | SSYAMN SEQ ID NO: 673 | WVAYIKSDTGSIG SEQ ID NO: 674 | AREPYSVWID SEQ ID NO: 675 | SSYLNWY SEQ ID NO: 676 | LLIYAASSLQ SEQ ID NO: 677 | QQSYSTPL SEQ ID NO: 678 |
| Ab165 | SSYAMS SEQ ID NO: 679 | WVAAIKSSTGTIY SEQ ID NO: 680 | AREPYSVWLD SEQ ID NO: 681 | IYYLNWY SEQ ID NO: 682 | LLIYAASSLQ SEQ ID NO: 683 | QQSYSTPL SEQ ID NO: 684 |
| Ab155 | SSYSMN SEQ ID NO: 685 | WVAAISGDTGTSG SEQ ID NO: 686 | AREPYSVWLD SEQ ID NO: 687 | SYYLNWY SEQ ID NO: 688 | LLIYAASSLQ SEQ ID NO: 689 | QQSYSTPL SEQ ID NO: 690 |
| Ab19 | SSYSMS SEQ ID NO: 691 | WVANIKSNSGYTY SEQ ID NO: 692 | AREPYSVWLD SEQ ID NO: 693 | SSYLNWY SEQ ID NO: 694 | LLIYAASSLQ SEQ ID NO: 695 | QQSYSTPL SEQ ID NO: 696 |
| Ab6 | SDYSMS SEQ ID NO: 697 | WVARISSSSSYKS SEQ ID NO: 698 | AREPYSVWLD SEQ ID NO: 699 | SSYLNWY SEQ ID NO: 700 | LLIYAASSLQ SEQ ID NO: 701 | QQSYSTPL SEQ ID NO: 702 |
| Ab187 | SSYSMS SEQ ID NO: 703 | WVASIKSDASTTG SEQ ID NO: 704 | AREPYSVWLD SEQ ID NO: 705 | SYYLNWY SEQ ID NO: 706 | LLIYAASSLQ SEQ ID NO: 707 | QQSYSTPL SEQ ID NO: 708 |
| Ab179 | SSYAMS SEQ ID NO: 709 | WVASIKSNTGSTY SEQ ID NO: 710 | AREPYSVWLD SEQ ID NO: 711 | SSYLNWY SEQ ID NO: 712 | LLIYAASSLQ SEQ ID NO: 713 | QQSYSTPL SEQ ID NO: 714 |
| Ab65 | SSYAMS | WVAYIKSNTGSIS | AREPYSVWLD | SSYLNWY | LLIYAASSLQ | QQSYSTPL |

FIG. 3D (ARE) CDRs

| clone | HCDR1 | HCDR2 | HCDR3 | LCDR1 | LCDR2 | LCDR3 |
|---|---|---|---|---|---|---|
|  | SEQ ID NO: 715 | SEQ ID NO: 716 | SEQ ID NO: 717 | SEQ ID NO: 718 | SEQ ID NO: 719 | SEQ ID NO: 720 |
| Ab114 | SSYSMS<br>SEQ ID NO: 721 | WVAYISSNTGSTY<br>SEQ ID NO: 722 | AREPYSVWLD<br>SEQ ID NO: 723 | SSYLNWY<br>SEQ ID NO: 724 | LLIYAASSLQ<br>SEQ ID NO: 725 | QQSYSTPL<br>SEQ ID NO: 726 |
| Ab102 | SSYAMS<br>SEQ ID NO: 727 | WVSAINSNAGYTY<br>SEQ ID NO: 728 | AREPYSVWLD<br>SEQ ID NO: 729 | SSYLNWY<br>SEQ ID NO: 730 | LLIYAASSLQ<br>SEQ ID NO: 731 | QQSYSTPL<br>SEQ ID NO: 732 |
| Ab94 | SSYAMS<br>SEQ ID NO: 733 | WVSAISGSGGSTY<br>SEQ ID NO: 734 | AREPYSVWLD<br>SEQ ID NO: 735 | SYYLNWY<br>SEQ ID NO: 736 | LLIYAASSLQ<br>SEQ ID NO: 737 | QQSYSTPL<br>SEQ ID NO: 738 |
| Ab163 | SSYAMS<br>SEQ ID NO: 739 | WVSAISGSGGSTY<br>SEQ ID NO: 740 | AREPYSVWLD<br>SEQ ID NO: 741 | SYYANWY<br>SEQ ID NO: 742 | LLIYAASSLQ<br>SEQ ID NO: 743 | QQSYSTPL<br>SEQ ID NO: 744 |
| Ab110 | SSYAMS<br>SEQ ID NO: 745 | WVSSIKSNTGSTY<br>SEQ ID NO: 746 | AREPYSVWLD<br>SEQ ID NO: 747 | SSYLNWY<br>SEQ ID NO: 748 | LLIYAASSLQ<br>SEQ ID NO: 749 | QQSYSTPL<br>SEQ ID NO: 750 |
| Ab80 | SSYSMS<br>SEQ ID NO: 751 | WVSSIKSSTGSTY<br>SEQ ID NO: 752 | AREPYSVWLD<br>SEQ ID NO: 753 | SSYLNWY<br>SEQ ID NO: 754 | LLIYAASSLQ<br>SEQ ID NO: 755 | QQSYSTPL<br>SEQ ID NO: 756 |
| Ab92 | SSYAMS<br>SEQ ID NO: 757 | WVAAIKSSASTIY<br>SEQ ID NO: 758 | AREPYSVWMD<br>SEQ ID NO: 759 | SYYLNWY<br>SEQ ID NO: 760 | LLIYAASSLQ<br>SEQ ID NO: 761 | QQSYSTPL<br>SEQ ID NO: 762 |
| Ab117 | SSYAMS<br>SEQ ID NO: 763 | WVAAIKSSASTIY<br>SEQ ID NO: 764 | AREPYSVWMD<br>SEQ ID NO: 765 | SYYLNWY<br>SEQ ID NO: 766 | LLIYAASSLQ<br>SEQ ID NO: 767 | QQSYSTPL<br>SEQ ID NO: 768 |
| Ab162 | SSYAMS<br>SEQ ID NO: 769 | WVAAIKSSASTIY<br>SEQ ID NO: 770 | AREPYSVWMD<br>SEQ ID NO: 771 | SYYLNWY<br>SEQ ID NO: 772 | LLIYAASSLQ<br>SEQ ID NO: 773 | QQSYSTPL<br>SEQ ID NO: 774 |
| Ab121 | SSYAMN<br>SEQ ID NO: 775 | WVAAISSSAGTSS<br>SEQ ID NO: 776 | AREPYSVWMD<br>SEQ ID NO: 777 | SSYLNWY<br>SEQ ID NO: 778 | LLIYAASSLQ<br>SEQ ID NO: 779 | QQSYSTPL<br>SEQ ID NO: 780 |
| Ab195 | SSYAMS<br>SEQ ID NO: 781 | WVADISGSASSSY<br>SEQ ID NO: 782 | AREPYSVWMD<br>SEQ ID NO: 783 | SYYLNWY<br>SEQ ID NO: 784 | LLIYAASSLQ<br>SEQ ID NO: 785 | QQSYSTPL<br>SEQ ID NO: 786 |
| Ab84 | SSYAMS<br>SEQ ID NO: 787 | WVASIKSSTGTSY<br>SEQ ID NO: 788 | AREPYSVWMD<br>SEQ ID NO: 789 | SSYLNWY<br>SEQ ID NO: 790 | LLIYAASSLQ<br>SEQ ID NO: 791 | QQSYSTPL<br>SEQ ID NO: 792 |
| Ab161 | SSYSMS<br>SEQ ID NO: 793 | WVASIKSSTGYTS<br>SEQ ID NO: 794 | AREPYSVWMD<br>SEQ ID NO: 795 | SSYLNWY<br>SEQ ID NO: 796 | LLIYAASSLQ<br>SEQ ID NO: 797 | QQSYSTPL<br>SEQ ID NO: 798 |
| Ab198 | SSYAMS<br>SEQ ID NO: 799 | WVASIKSSTSSTY<br>SEQ ID NO: 800 | AREPYSVWMD<br>SEQ ID NO: 801 | SSYLNWY<br>SEQ ID NO: 802 | LLIYAASSLQ<br>SEQ ID NO: 803 | QQSYSTPL<br>SEQ ID NO: 804 |
| Ab24 | SSYAMS<br>SEQ ID NO: 805 | WVSAISGSGGSTY<br>SEQ ID NO: 806 | AREPYSVWMD<br>SEQ ID NO: 807 | SSYLNWY<br>SEQ ID NO: 808 | LLIYAASSLQ<br>SEQ ID NO: 809 | QQSYSTPL<br>SEQ ID NO: 810 |
| Ab98 | SSYAMS<br>SEQ ID NO: 811 | WVSAISGSGGSTY<br>SEQ ID NO: 812 | AREPYSVWMD<br>SEQ ID NO: 813 | SYYLNWY<br>SEQ ID NO: 814 | LLIYAASSLQ<br>SEQ ID NO: 815 | QQSYSTPL<br>SEQ ID NO: 816 |
| Ab116 | SSYAMS<br>SEQ ID NO: 817 | WVSAISGSGGSTY<br>SEQ ID NO: 818 | AREPYSVWMD<br>SEQ ID NO: 819 | SSYLNWY<br>SEQ ID NO: 820 | LLIYAASSLQ<br>SEQ ID NO: 821 | QQSYSTPL<br>SEQ ID NO: 822 |
| Ab174 | SSYAMS | WVSAISGSGGSTY | AREPYSVWMD | SYYLNWY | LLIYAASSLQ | QQSYSTPL |

FIG. 3E
(ARE) CDRs

| clone | HCDR1 | HCDR2 | HCDR3 | LCDR1 | LCDR2 | LCDR3 |
|---|---|---|---|---|---|---|
|  | SEQ ID NO: 823 | SEQ ID NO: 824 | SEQ ID NO: 825 | SEQ ID NO: 826 | SEQ ID NO: 827 | SEQ ID NO: 828 |
| Ab196 | SSYSMN SEQ ID NO: 829 | WVSSIKGSAGTTS SEQ ID NO: 830 | AREPYSVWMD SEQ ID NO: 831 | SYYLNWY SEQ ID NO: 832 | LLIYAASSLQ SEQ ID NO: 833 | QQSYSTPL SEQ ID NO: 834 |
| Ab51 | SSYAMS SEQ ID NO: 835 | WVSSIKSNSGSKS SEQ ID NO: 836 | AREPYSVWMD SEQ ID NO: 837 | SSYLNWY SEQ ID NO: 838 | LLIYAASSLQ SEQ ID NO: 839 | QQSYSTPL SEQ ID NO: 840 |
| Ab91 | SSYSMS SEQ ID NO: 841 | WVAAIKGSAGSSS SEQ ID NO: 842 | AREPYSYWLD SEQ ID NO: 843 | SSYLNWY SEQ ID NO: 844 | LLIYAASSLQ SEQ ID NO: 845 | QQSYSTPL SEQ ID NO: 846 |
| Ab185 | SSYAMS SEQ ID NO: 847 | WVAAIKSNAGSSY SEQ ID NO: 848 | AREPYSYWLD SEQ ID NO: 849 | SSYLNWY SEQ ID NO: 850 | LLIYAASSLQ SEQ ID NO: 851 | QQSYSTPL SEQ ID NO: 852 |
| Ab23 | SSYAMS SEQ ID NO: 853 | WVARINSDSSNTY SEQ ID NO: 854 | AREPYSYWLD SEQ ID NO: 855 | SSYLNWY SEQ ID NO: 856 | LLIYAASSLQ SEQ ID NO: 857 | QQSYSTPL SEQ ID NO: 858 |
| Ab7 | SSYAMS SEQ ID NO: 859 | WVASIKSSSSSIS SEQ ID NO: 860 | AREPYSYWLD SEQ ID NO: 861 | SSYLNWY SEQ ID NO: 862 | LLIYAASSLQ SEQ ID NO: 863 | QQSYSTPL SEQ ID NO: 864 |
| Ab95 | SSYAMS SEQ ID NO: 865 | WVASIKSSTGYIG SEQ ID NO: 866 | AREPYSYWLD SEQ ID NO: 867 | SSYLNWY SEQ ID NO: 868 | LLIYAASSLQ SEQ ID NO: 869 | QQSYSTPL SEQ ID NO: 870 |
| Ab100 | SSYAMS SEQ ID NO: 871 | WVASINGNAGTIS SEQ ID NO: 872 | AREPYSYWLD SEQ ID NO: 873 | SSYLNWY SEQ ID NO: 874 | LLIYAASSLQ SEQ ID NO: 875 | QQSYSTPL SEQ ID NO: 876 |
| Ab140 | SSYAMS SEQ ID NO: 877 | WVASINSNTGSIG SEQ ID NO: 878 | AREPYSYWLD SEQ ID NO: 879 | SSYLNWY SEQ ID NO: 880 | LLIYAASSLQ SEQ ID NO: 881 | QQSYSTPL SEQ ID NO: 882 |
| Ab145 | SSYAMS SEQ ID NO: 883 | WVASISSSTGYTS SEQ ID NO: 884 | AREPYSYWLD SEQ ID NO: 885 | SSYLNWY SEQ ID NO: 886 | LLIYAASSLQ SEQ ID NO: 887 | QQSYSTPL SEQ ID NO: 888 |
| Ab150 | SSYAMS SEQ ID NO: 889 | WVSAISGSGGSTY SEQ ID NO: 890 | AREPYSYWLD SEQ ID NO: 891 | SSYVAWY SEQ ID NO: 892 | LLIYVNTSRA SEQ ID NO: 893 | QQWYEFNL SEQ ID NO: 894 |
| Ab168 | SSYAMS SEQ ID NO: 895 | WVSSIKSDTSSTY SEQ ID NO: 896 | AREPYSYWLD SEQ ID NO: 897 | SSYLNWY SEQ ID NO: 898 | LLIYAASSLQ SEQ ID NO: 899 | QQSYSTPL SEQ ID NO: 900 |
| Ab54 | SSYAMS SEQ ID NO: 901 | WVSSIKSNTGSTS SEQ ID NO: 902 | AREPYSYWLD SEQ ID NO: 903 | SSYLNWY SEQ ID NO: 904 | LLIYAASSLQ SEQ ID NO: 905 | QQSYSTPL SEQ ID NO: 906 |
| Ab77 | SSYSMN SEQ ID NO: 907 | WVAAISGNTGYTY SEQ ID NO: 908 | AREPYSYWMD SEQ ID NO: 909 | SSYLNWY SEQ ID NO: 910 | LLIYAASSLQ SEQ ID NO: 911 | QQSYSTPL SEQ ID NO: 912 |
| Ab43 | SSYAMS SEQ ID NO: 913 | WVANIKSNSGYTS SEQ ID NO: 914 | AREPYSYWMD SEQ ID NO: 915 | SSYLNWY SEQ ID NO: 916 | LLIYAASSLQ SEQ ID NO: 917 | QQSYSTPL SEQ ID NO: 918 |
| Ab160 | DSYAMN SEQ ID NO: 919 | WVASIKSNAGYSS SEQ ID NO: 920 | AREPYSYWMD SEQ ID NO: 921 | SSYLNWY SEQ ID NO: 922 | LLIYAASSLQ SEQ ID NO: 923 | QQSYSTPL SEQ ID NO: 924 |
| Ab82 | SSYAMN SEQ ID NO: 925 | WVASIKSNTGTTG SEQ ID NO: 926 | AREPYSYWMD SEQ ID NO: 927 | SSYLNWY SEQ ID NO: 928 | LLIYAASSLQ SEQ ID NO: 929 | QQSYSTPL SEQ ID NO: 930 |
| Ab189 | SSYSMS | WVASIKSSASYSS | AREPYSYWMD | SSYLNWY | LLIYAASSLQ | QQSYSTPL |

FIG. 3F
(ARE) CDRs

| clone | HCDR1 | HCDR2 | HCDR3 | LCDR1 | LCDR2 | LCDR3 |
|---|---|---|---|---|---|---|
|  | SEQ ID NO: 931 | SEQ ID NO: 932 | SEQ ID NO: 933 | SEQ ID NO: 934 | SEQ ID NO: 935 | SEQ ID NO: 936 |
| Ab17 | SSYAMS SEQ ID NO: 937 | WVASIKSSGGNTY SEQ ID NO: 938 | AREPYSYWMD SEQ ID NO: 939 | SSYLNWY SEQ ID NO: 940 | LLIYAASSLQ SEQ ID NO: 941 | QQSYSTPL SEQ ID NO: 942 |
| Ab103 | SSYAMS SEQ ID NO: 943 | WVASIKSSTSSTY SEQ ID NO: 944 | AREPYSYWMD SEQ ID NO: 945 | SSYLNWY SEQ ID NO: 946 | LLIYAASSLQ SEQ ID NO: 947 | QQSYSTPL SEQ ID NO: 948 |
| Ab18 | SSYAMS SEQ ID NO: 949 | WVASISSGGNTY SEQ ID NO: 950 | AREPYSYWMD SEQ ID NO: 951 | SSYLNWY SEQ ID NO: 952 | LLIYAASSLQ SEQ ID NO: 953 | QQSYSTPL SEQ ID NO: 954 |
| Ab130 | SSYAMS SEQ ID NO: 955 | WVSAISGSGGSTY SEQ ID NO: 956 | AREPYSYWMD SEQ ID NO: 957 | SSYLNWY SEQ ID NO: 958 | LLIYAASSLQ SEQ ID NO: 959 | QQSYSTPL SEQ ID NO: 960 |
| Ab132 | SSYAMN SEQ ID NO: 961 | WVSSISGNAGSIY SEQ ID NO: 962 | AREPYSYWMD SEQ ID NO: 963 | SSYLNWY SEQ ID NO: 964 | LLIYAASSLQ SEQ ID NO: 965 | QQSYSTPL SEQ ID NO: 966 |
| Ab134 | SSYAMN SEQ ID NO: 967 | WVSSISGNAGSIY SEQ ID NO: 968 | AREPYSYWMD SEQ ID NO: 969 | SSYLNWY SEQ ID NO: 970 | LLIYAASSLQ SEQ ID NO: 971 | QQSYSTPL SEQ ID NO: 972 |
| Ab144 | SSYAMN SEQ ID NO: 973 | WVSSISGNAGSIY SEQ ID NO: 974 | AREPYSYWMD SEQ ID NO: 975 | SSYLNWY SEQ ID NO: 976 | LLIYAASSLQ SEQ ID NO: 977 | QQSYSTPL SEQ ID NO: 978 |

FIG. 3G (ARG) CDRs

| clone | HCDR1 | HCDR2 | HCDR3 | LCDR1 | LCDR2 | LCDR3 |
|---|---|---|---|---|---|---|
| Ab2 | SSYGMN | WVAGINYSSGNKY | ARGPYASTWLD | SSYLNWY | LLIYAASSLQ | QQSYSTPL |
|  | SEQ ID NO: 979 | SEQ ID NO: 980 | SEQ ID NO: 981 | SEQ ID NO: 982 | SEQ ID NO: 983 | SEQ ID NO: 984 |
| Ab47 | SSYSMN | WVASIKSSSSYTS | ARGPYDTWLD | SSYLNWY | LLIYAASSLQ | QQSYSTPL |
|  | SEQ ID NO: 985 | SEQ ID NO: 986 | SEQ ID NO: 987 | SEQ ID NO: 988 | SEQ ID NO: 989 | SEQ ID NO: 990 |
| Ab49 | SSYSMH | WVASIKSSGGYKS | ARGPYDVWID | SSYLNWY | LLIYAASSLQ | QQSYSTPL |
|  | SEQ ID NO: 991 | SEQ ID NO: 992 | SEQ ID NO: 993 | SEQ ID NO: 994 | SEQ ID NO: 995 | SEQ ID NO: 996 |
| Ab31 | SSYTMH | WVANIKSSSSTKY | ARGPYDVWLD | SSYLNWY | LLIYAASSLQ | QQSYSTPL |
|  | SEQ ID NO: 997 | SEQ ID NO: 998 | SEQ ID NO: 999 | SEQ ID NO: 1000 | SEQ ID NO: 1001 | SEQ ID NO: 1002 |
| Ab53 | SSYSMH | WVASIKSSSSNKY | ARGPYDVWLD | SSYLNWY | LLIYAASSLQ | QQSYSTPL |
|  | SEQ ID NO: 1003 | SEQ ID NO: 1004 | SEQ ID NO: 1005 | SEQ ID NO: 1006 | SEQ ID NO: 1007 | SEQ ID NO: 1008 |
| Ab40 | SSYGMN | WVAGIKYSSGNKY | ARGPYDVWMD | SSYLNWY | LLIYAASSLQ | QQSYSTPL |
|  | SEQ ID NO: 1009 | SEQ ID NO: 1010 | SEQ ID NO: 1011 | SEQ ID NO: 1012 | SEQ ID NO: 1013 | SEQ ID NO: 1014 |
| Ab5 | SDYSMN | WVALIKSNSGSTS | ARGPYDVWMD | SSYLNWY | LLIYAASSLQ | QQSYSTPL |
|  | SEQ ID NO: 1015 | SEQ ID NO: 1016 | SEQ ID NO: 1017 | SEQ ID NO: 1018 | SEQ ID NO: 1019 | SEQ ID NO: 1020 |
| Ab9 | DSYSMH | WVANIKSSGGYIS | ARGPYDVWMD | SSYLNWY | LLIYAASSLQ | QQSYSTPL |
|  | SEQ ID NO: 1021 | SEQ ID NO: 1022 | SEQ ID NO: 1023 | SEQ ID NO: 1024 | SEQ ID NO: 1025 | SEQ ID NO: 1026 |
| Ab48 | SSYSMN | WVANIKSSGSSTS | ARGPYDVWMD | SSYLNWY | LLIYAASSLQ | QQSYSTPL |
|  | SEQ ID NO: 1027 | SEQ ID NO: 1028 | SEQ ID NO: 1029 | SEQ ID NO: 1030 | SEQ ID NO: 1031 | SEQ ID NO: 1032 |
| Ab4 | DSYGMN | WVASIKYSSGYKY | ARGPYDVWMD | SSYLNWY | LLIYAASSLQ | QQSYSTPL |
|  | SEQ ID NO: 1033 | SEQ ID NO: 1034 | SEQ ID NO: 1035 | SEQ ID NO: 1036 | SEQ ID NO: 1037 | SEQ ID NO: 1038 |
| Ab10 | SSYSMN | WVAYIKSNSGTKG | ARGPYDYWLD | SSYLNWY | LLIYAASSLQ | QQSYSTPL |
|  | SEQ ID NO: 1039 | SEQ ID NO: 1040 | SEQ ID NO: 1041 | SEQ ID NO: 1042 | SEQ ID NO: 1043 | SEQ ID NO: 1044 |
| Ab37 | SSYGMN | WVSDINSNSGSTS | ARGPYGVWLD | SSYLNWY | LLIYAASSLQ | QQSYSTPL |
|  | SEQ ID NO: 1045 | SEQ ID NO: 1046 | SEQ ID NO: 1047 | SEQ ID NO: 1048 | SEQ ID NO: 1049 | SEQ ID NO: 1050 |
| Ab33 | SSYGMH | WVSDISSNGGTIY | ARGPYGVWLD | SSYLNWY | LLIYAASSLQ | QQSYSTPL |
|  | SEQ ID NO: 1051 | SEQ ID NO: 1052 | SEQ ID NO: 1053 | SEQ ID NO: 1054 | SEQ ID NO: 1055 | SEQ ID NO: 1056 |
| Ab42 | SSYGMH | WVARINSNGGSKS | ARGPYGYWFD | SSYLNWY | LLIYAASSLQ | QQSYSTPL |
|  | SEQ ID NO: 1057 | SEQ ID NO: 1058 | SEQ ID NO: 1059 | SEQ ID NO: 1060 | SEQ ID NO: 1061 | SEQ ID NO: 1062 |
| Ab45 | SSYGMN | WVARISSSGSYIG | ARGPYGYWLD | SSYLNWY | LLIYAASSLQ | QQSYSTPL |
|  | SEQ ID NO: 1063 | SEQ ID NO: 1064 | SEQ ID NO: 1065 | SEQ ID NO: 1066 | SEQ ID NO: 1067 | SEQ ID NO: 1068 |

FIG. 3H
(ARV) CDRs

| clone | HCDR1 | HCDR2 | HCDR3 | LCDR1 | LCDR2 | LCDR3 |
|---|---|---|---|---|---|---|
| Ab44 | SSYSMH SEQ ID NO: 1069 | WVSAISSDGSYIS SEQ ID NO: 1070 | ARVPYDVWFD SEQ ID NO: 1071 | SSYLNWY SEQ ID NO: 1072 | LLIYAASSLQ SEQ ID NO: 1073 | QQSYSTPL SEQ ID NO: 1074 |
| Ab97 | SSYSMH SEQ ID NO: 1075 | WVAAISSNTGSIG SEQ ID NO: 1076 | ARVPYDVWID SEQ ID NO: 1077 | SSYLNWY SEQ ID NO: 1078 | LLIYAASSLQ SEQ ID NO: 1079 | QQSYSTPL SEQ ID NO: 1080 |
| Ab81 | SSYSMH SEQ ID NO: 1081 | WVASIKGNTGSSG SEQ ID NO: 1082 | ARVPYDVWID SEQ ID NO: 1083 | SSYLNWY SEQ ID NO: 1084 | LLIYAASSLQ SEQ ID NO: 1085 | QQSYSTPL SEQ ID NO: 1086 |
| Ab188 | SSYSMH SEQ ID NO: 1087 | WVASIKSNAGTSS SEQ ID NO: 1088 | ARVPYDVWID SEQ ID NO: 1089 | SSYLNWY SEQ ID NO: 1090 | LLIYAASSLQ SEQ ID NO: 1091 | QQSYSTPL SEQ ID NO: 1092 |
| Ab186 | SSYSMH SEQ ID NO: 1093 | WVASISSNAGYSS SEQ ID NO: 1094 | ARVPYDVWID SEQ ID NO: 1095 | SSYLNWY SEQ ID NO: 1096 | LLIYAASSLQ SEQ ID NO: 1097 | QQSYSTPL SEQ ID NO: 1098 |
| Ab62 | SSYSMS SEQ ID NO: 1099 | WVASISSSAGYSY SEQ ID NO: 1100 | ARVPYDVWID SEQ ID NO: 1101 | SSYLNWY SEQ ID NO: 1102 | LLIYAASSLQ SEQ ID NO: 1103 | QQSYSTPL SEQ ID NO: 1104 |
| Ab57 | SSYSMH SEQ ID NO: 1105 | WVAYIKSDTSTIG SEQ ID NO: 1106 | ARVPYDVWID SEQ ID NO: 1107 | SSYLNWY SEQ ID NO: 1108 | LLIYAASSLQ SEQ ID NO: 1109 | QQSYSTPL SEQ ID NO: 1110 |
| Ab192 | SSYAMH SEQ ID NO: 1111 | WVSSISSDTGYIG SEQ ID NO: 1112 | ARVPYDVWID SEQ ID NO: 1113 | SYYVNWY SEQ ID NO: 1114 | LLIYAASSLQ SEQ ID NO: 1115 | QQSYSTPL SEQ ID NO: 1116 |
| Ab73 | SSYSMS SEQ ID NO: 1117 | WVASIKGSAGSSS SEQ ID NO: 1118 | ARVPYDVWLD SEQ ID NO: 1119 | SSYLNWY SEQ ID NO: 1120 | LLIYAASSLQ SEQ ID NO: 1121 | QQSYSTPL SEQ ID NO: 1122 |
| Ab60 | SSYSMH SEQ ID NO: 1123 | WVSSISSSAGYTS SEQ ID NO: 1124 | ARVPYDVWLD SEQ ID NO: 1125 | SSYLNWY SEQ ID NO: 1126 | LLIYAASSLQ SEQ ID NO: 1127 | QQSYSTPL SEQ ID NO: 1128 |
| Ab28 | SSYSMH SEQ ID NO: 1129 | WVANINSNGGNTG SEQ ID NO: 1130 | ARVPYDVWMD SEQ ID NO: 1131 | SSYLNWY SEQ ID NO: 1132 | LLIYAASSLQ SEQ ID NO: 1133 | QQSYSTPL SEQ ID NO: 1134 |
| Ab32 | SSYSMH SEQ ID NO: 1135 | WVANINSNGGNTG SEQ ID NO: 1136 | ARVPYDVWMD SEQ ID NO: 1137 | SSYLNWY SEQ ID NO: 1138 | LLIYAASSLQ SEQ ID NO: 1139 | QQSYSTPL SEQ ID NO: 1140 |
| Ab78 | SSYSMH SEQ ID NO: 1141 | WVASISGSTSSSS SEQ ID NO: 1142 | ARVPYDVWMD SEQ ID NO: 1143 | SSYLNWY SEQ ID NO: 1144 | LLIYAASSLQ SEQ ID NO: 1145 | QQSYSTPL SEQ ID NO: 1146 |
| Ab14 | SSYGMH SEQ ID NO: 1147 | WVSSISSSGGTKG SEQ ID NO: 1148 | ARVPYDVWMD SEQ ID NO: 1149 | SSYLNWY SEQ ID NO: 1150 | LLIYAASSLQ SEQ ID NO: 1151 | QQSYSTPL SEQ ID NO: 1152 |
| Ab152 | SSYSMH SEQ ID NO: 1153 | WVTSISSNAGYIS SEQ ID NO: 1154 | ARVPYDVWMD SEQ ID NO: 1155 | SSYLNWY SEQ ID NO: 1156 | LLIYAASSLQ SEQ ID NO: 1157 | QQSYSTPL SEQ ID NO: 1158 |
| Ab72 | SSYSMH SEQ ID NO: 1159 | WVAAIKSDAGTSG SEQ ID NO: 1160 | ARVPYDYWID SEQ ID NO: 1161 | SSYLNWY SEQ ID NO: 1162 | LLIYAASSLQ SEQ ID NO: 1163 | QQSYSTPL SEQ ID NO: 1164 |
| Ab137 | SSYSMH SEQ ID NO: 1165 | WVASIKGNTGSIS SEQ ID NO: 1166 | ARVPYDYWID SEQ ID NO: 1167 | SSYLNWY SEQ ID NO: 1168 | LLIYAASSLQ SEQ ID NO: 1169 | QQSYSTPL SEQ ID NO: 1170 |
| Ab128 | SSYSMN | WVASIKGSASYTS | ARVPYDYWID | SSYLNWY | LLIYAASSLQ | QQSYSTPL |

FIG. 31

(ARV) CDRs

| clone | HCDR1 | HCDR2 | HCDR3 | LCDR1 | LCDR2 | LCDR3 |
|---|---|---|---|---|---|---|
| Ab169 | SSYSMH SEQ ID NO: 1171 | WVASIKSDTSSTY SEQ ID NO: 1172 | ARVPYDYWID SEQ ID NO: 1173 | SSYLNWY SEQ ID NO: 1174 | LLIYAASSLQ SEQ ID NO: 1175 | QQSYSTPL SEQ ID NO: 1176 |
| Ab87 | SSYSMS SEQ ID NO: 1177 | WVASIKSSAGYIS SEQ ID NO: 1178 | ARVPYDYWID SEQ ID NO: 1179 | SSYLNWY SEQ ID NO: 1180 | LLIYAASSLQ SEQ ID NO: 1181 | QQSYSTPL SEQ ID NO: 1182 |
| Ab74 | SSYSMH SEQ ID NO: 1183 | WVASISSNAGTTG SEQ ID NO: 1184 | ARVPYDYWID SEQ ID NO: 1185 | SSYLNWY SEQ ID NO: 1186 | LLIYAASSLQ SEQ ID NO: 1187 | QQSYSTPL SEQ ID NO: 1188 |
| Ab172 | SSYSMH SEQ ID NO: 1189 | WVSSIKSSAGYTY SEQ ID NO: 1190 | ARVPYDYWID SEQ ID NO: 1191 | SSYLNWY SEQ ID NO: 1192 | LLIYAASSLQ SEQ ID NO: 1193 | QQSYSTPL SEQ ID NO: 1194 |
| Ab153 | SSYSMH SEQ ID NO: 1195 | WVSSINSNAGTIS SEQ ID NO: 1196 | ARVPYDYWID SEQ ID NO: 1197 | SSYLNWY SEQ ID NO: 1198 | LLIYAASSLQ SEQ ID NO: 1199 | QQSYSTPL SEQ ID NO: 1200 |
| Ab120 | SSYSMN SEQ ID NO: 1201 | WVSSINSNAGTIY SEQ ID NO: 1202 | ARVPYDYWID SEQ ID NO: 1203 | SSYLNWY SEQ ID NO: 1204 | LLIYAASSLQ SEQ ID NO: 1205 | QQSYSTPL SEQ ID NO: 1206 |
| Ab13 | DSYSMH SEQ ID NO: 1207 | WVSSINSNGGYKY SEQ ID NO: 1208 | ARVPYDYWID SEQ ID NO: 1209 | SSYLNWY SEQ ID NO: 1210 | LLIYAASSLQ SEQ ID NO: 1211 | QQSYSTPL SEQ ID NO: 1212 |
| Ab113 | SSYSMN SEQ ID NO: 1213 | WVTSISSSASTTG SEQ ID NO: 1214 | ARVPYDYWID SEQ ID NO: 1215 | SSYLNWY SEQ ID NO: 1216 | LLIYAASSLQ SEQ ID NO: 1217 | QQSYSTPL SEQ ID NO: 1218 |
| Ab16 | SSYSMH SEQ ID NO: 1219 | WVAAIKSSGSSTS SEQ ID NO: 1220 | ARVPYDYWLD SEQ ID NO: 1221 | SSYLNWY SEQ ID NO: 1222 | LLIYAASSLQ SEQ ID NO: 1223 | QQSYSTPL SEQ ID NO: 1224 |
| Ab56 | SSYSMS SEQ ID NO: 1225 | WVASINSNAGTIS SEQ ID NO: 1226 | ARVPYDYWLD SEQ ID NO: 1227 | SSYLNWY SEQ ID NO: 1228 | LLIYAASSLQ SEQ ID NO: 1229 | QQSYSTPL SEQ ID NO: 1230 |
| Ab129 | SSYSMH SEQ ID NO: 1231 | WVSSISSSAGTSG SEQ ID NO: 1232 | ARVPYDYWLD SEQ ID NO: 1233 | SSYLNWY SEQ ID NO: 1234 | LLIYAASSLQ SEQ ID NO: 1235 | QQSYSTPL SEQ ID NO: 1236 |
| Ab50 | SSYSMH SEQ ID NO: 1237 | WVAAIKSNGGYIY SEQ ID NO: 1238 | ARVPYDYWMD SEQ ID NO: 1239 | SSYLNWY SEQ ID NO: 1240 | LLIYAASSLQ SEQ ID NO: 1241 | QQSYSTPL SEQ ID NO: 1242 |
| Ab90 | SSYAMH SEQ ID NO: 1243 | WVAAISSNTGYIY SEQ ID NO: 1244 | ARVPYDYWMD SEQ ID NO: 1245 | SSYLNWY SEQ ID NO: 1246 | LLIYAASSLQ SEQ ID NO: 1247 | QQSYSTPL SEQ ID NO: 1248 |
| Ab99 | SSYSMS SEQ ID NO: 1249 | WVAAISSSASTTS SEQ ID NO: 1250 | ARVPYDYWMD SEQ ID NO: 1251 | SSYLNWY SEQ ID NO: 1252 | LLIYAASSLQ SEQ ID NO: 1253 | QQSYSTPL SEQ ID NO: 1254 |
| Ab3 | SDYGMH SEQ ID NO: 1255 | WVAGIWYNGGYKS SEQ ID NO: 1256 | ARVPYDYWMD SEQ ID NO: 1257 | SSYLNWY SEQ ID NO: 1258 | LLIYAASSLQ SEQ ID NO: 1259 | QQSYSTPL SEQ ID NO: 1260 |
| Ab148 | SSYSMS SEQ ID NO: 1261 | WVASIKGSAGYIY SEQ ID NO: 1262 | ARVPYDYWMD SEQ ID NO: 1263 | SSYLNWY SEQ ID NO: 1264 | LLIYAASSLQ SEQ ID NO: 1265 | QQSYSTPL SEQ ID NO: 1266 |
| Ab124 | SSYSMH SEQ ID NO: 1267 | WVASIKGSASYSY SEQ ID NO: 1268 | ARVPYDYWMD SEQ ID NO: 1269 | SSYLNWY SEQ ID NO: 1270 | LLIYAASSLQ SEQ ID NO: 1271 | QQSYSTPL SEQ ID NO: 1272 |
| | SEQ ID NO: 1273 | SEQ ID NO: 1274 | SEQ ID NO: 1275 | SEQ ID NO: 1276 | SEQ ID NO: 1277 | SEQ ID NO: 1278 |
| Ab22 | SSYSMH | WVASIKSSGGSKY | ARVPYDYWMD | SSYLNWY | LLIYAASSLQ | QQSYSTPL |

FIG. 3J (ARV) CDRs

| clone | HCDR1 | HCDR2 | HCDR3 | LCDR1 | LCDR2 | LCDR3 |
|---|---|---|---|---|---|---|
|  | SEQ ID NO: 1279 | SEQ ID NO: 1280 | SEQ ID NO: 1281 | SEQ ID NO: 1282 | SEQ ID NO: 1283 | SEQ ID NO: 1284 |
|  | SSYSMH | WVASIKSSGGYIS | ARVPYDYWMD | SSYLNWY | LLIYAASSLQ | QQSYSTPL |
| Ab41 | SEQ ID NO: 1285 | SEQ ID NO: 1286 | SEQ ID NO: 1287 | SEQ ID NO: 1288 | SEQ ID NO: 1289 | SEQ ID NO: 1290 |
|  | SSYSMS | WVASIKSSTGTIS | ARVPYDYWMD | SSYLNWY | LLIYAASSLQ | QQSYSTPL |
| Ab119 | SEQ ID NO: 1291 | SEQ ID NO: 1292 | SEQ ID NO: 1293 | SEQ ID NO: 1294 | SEQ ID NO: 1295 | SEQ ID NO: 1296 |
|  | SSYSMN | WVASINSNAGSTY | ARVPYDYWMD | SSYLNWY | LLIYAASSLQ | QQSYSTPL |
| Ab157 | SEQ ID NO: 1297 | SEQ ID NO: 1298 | SEQ ID NO: 1299 | SEQ ID NO: 1300 | SEQ ID NO: 1301 | SEQ ID NO: 1302 |
|  | SSYSMX | WVASISSSGGSIY | ARVPYDYWMD | SSYLNWY | LLIYAASSLQ | QQSYSTPL |
| Ab27 | SEQ ID NO: 1303 | SEQ ID NO: 1304 | SEQ ID NO: 1305 | SEQ ID NO: 1306 | SEQ ID NO: 1307 | SEQ ID NO: 1308 |
|  | SSYSMH | WVASIWSNSGNTG | ARVPYDYWMD | SSYLNWY | LLIYAASSLQ | QQSYSTPL |
| Ab15 | SEQ ID NO: 1309 | SEQ ID NO: 1310 | SEQ ID NO: 1311 | SEQ ID NO: 1312 | SEQ ID NO: 1313 | SEQ ID NO: 1314 |
|  | SSYSMH | WVSSIKSSASYSS | ARVPYDYWMD | SSYLNWY | LLIYAASSLQ | QQSYSTPL |
| Ab191 | SEQ ID NO: 1315 | SEQ ID NO: 1316 | SEQ ID NO: 1317 | SEQ ID NO: 1318 | SEQ ID NO: 1319 | SEQ ID NO: 1320 |
|  | SSYAMH | WVAAIKSSAGYSY | ARVPYGVWID | SYYLNWY | LLIYAASSLQ | QQSYSTPL |
| Ab190 | SEQ ID NO: 1321 | SEQ ID NO: 1322 | SEQ ID NO: 1323 | SEQ ID NO: 1324 | SEQ ID NO: 1325 | SEQ ID NO: 1326 |
|  | SSYAMH | WVADIKSNTGYTY | ARVPYGVWID | SYYANWY | LLIYAASSLQ | QQSYSTPL |
| Ab79 | SEQ ID NO: 1327 | SEQ ID NO: 1328 | SEQ ID NO: 1329 | SEQ ID NO: 1330 | SEQ ID NO: 1331 | SEQ ID NO: 1332 |
|  | SSYAMS | WVASIKSSTGYTY | ARVPYGVWID | SYYLNWY | LLIYAASSLQ | QQSYSTPL |
| Ab181 | SEQ ID NO: 1333 | SEQ ID NO: 1334 | SEQ ID NO: 1335 | SEQ ID NO: 1336 | SEQ ID NO: 1337 | SEQ ID NO: 1338 |
|  | SSYAMH | WVASISGNAGSSS | ARVPYGVWID | SYYLNWY | LLIYAASSLQ | QQSYSTPL |
| Ab146 | SEQ ID NO: 1339 | SEQ ID NO: 1340 | SEQ ID NO: 1341 | SEQ ID NO: 1342 | SEQ ID NO: 1343 | SEQ ID NO: 1344 |
|  | SSYAMH | WVASISGNAGSSS | ARVPYGVWID | SYYLNWY | LLIYAASSLQ | QQSYSTPL |
| Ab167 | SEQ ID NO: 1345 | SEQ ID NO: 1346 | SEQ ID NO: 1347 | SEQ ID NO: 1348 | SEQ ID NO: 1349 | SEQ ID NO: 1350 |
|  | SSYSMS | WVASISSSAGTTS | ARVPYGVWID | SSYLNWY | LLIYAASSLQ | QQSYSTPL |
| Ab88 | SEQ ID NO: 1351 | SEQ ID NO: 1352 | SEQ ID NO: 1353 | SEQ ID NO: 1354 | SEQ ID NO: 1355 | SEQ ID NO: 1356 |
|  | SSYSMH | WVASISSSASTSG | ARVPYGVWID | SYYLNWY | LLIYAASSLQ | QQSYSTPL |
| Ab199 | SEQ ID NO: 1357 | SEQ ID NO: 1358 | SEQ ID NO: 1359 | SEQ ID NO: 1360 | SEQ ID NO: 1361 | SEQ ID NO: 1362 |
|  | SSYSMH | WVASISSSASTSY | ARVPYGVWID | SSYLNWY | LLIYAASSLQ | QQSYSTPL |
| Ab71 | SEQ ID NO: 1363 | SEQ ID NO: 1364 | SEQ ID NO: 1365 | SEQ ID NO: 1366 | SEQ ID NO: 1367 | SEQ ID NO: 1368 |
|  | SSYAMS | WVSAISGSGGSTY | ARVPYGVWID | SYYLNWY | LLIYAASSLQ | QQSYSTPL |
| Ab85 | SEQ ID NO: 1369 | SEQ ID NO: 1370 | SEQ ID NO: 1371 | SEQ ID NO: 1372 | SEQ ID NO: 1373 | SEQ ID NO: 1374 |
|  | SSYAMN | WVAAISGNAGSSS | ARVPYGVWLD | SSYLNWY | LLIYAASSLQ | QQSYSTPL |
| Ab59 | SEQ ID NO: 1375 | SEQ ID NO: 1376 | SEQ ID NO: 1377 | SEQ ID NO: 1378 | SEQ ID NO: 1379 | SEQ ID NO: 1380 |
|  | SSYAMS | WVSAISGSGGSTY | ARVPYGVWLD | SYYLNWY | LLIYAASSLQ | QQSYSTPL |
| Ab141 | SEQ ID NO: 1381 | SEQ ID NO: 1382 | SEQ ID NO: 1383 | SEQ ID NO: 1384 | SEQ ID NO: 1385 | SEQ ID NO: 1386 |
| Ab68 | SSYSMH | WVAAIKGNTGSTY | ARVPYGVWMD | SSYLNWY | LLIYAASSLQ | QQSYSTPL |

FIG. 3K (ARV) CDRs

| clone | HCDR1 | HCDR2 | HCDR3 | LCDR1 | LCDR2 | LCDR3 |
|---|---|---|---|---|---|---|
| | SEQ ID NO: 1387 | SEQ ID NO: 1388 | SEQ ID NO: 1389 | SEQ ID NO: 1390 | SEQ ID NO: 1391 | SEQ ID NO: 1392 |
| Ab143 | SSYSMH SEQ ID NO: 1393 | WVAAINSNAGSSS SEQ ID NO: 1394 | ARVPYGVWMD SEQ ID NO: 1395 | SYYLNWY SEQ ID NO: 1396 | LLIYAASSLQ SEQ ID NO: 1397 | QQSYSTPL SEQ ID NO: 1398 |
| Ab46 | SSYSMH SEQ ID NO: 1399 | WVAGIWSSGGTTS SEQ ID NO: 1400 | ARVPYGVWMD SEQ ID NO: 1401 | SSYLNWY SEQ ID NO: 1402 | LLIYAASSLQ SEQ ID NO: 1403 | QQSYSTPL SEQ ID NO: 1404 |
| Ab197 | SSYSMH SEQ ID NO: 1405 | WVAYIKGSAGSTS SEQ ID NO: 1406 | ARVPYGVWMD SEQ ID NO: 1407 | SYYLNWY SEQ ID NO: 1408 | LLIYAASSLQ SEQ ID NO: 1409 | QQSYSTPL SEQ ID NO: 1410 |
| Ab175 | SSYSMH SEQ ID NO: 1411 | WVSAINSNAGSSS SEQ ID NO: 1412 | ARVPYGVWMD SEQ ID NO: 1413 | SYYLNWY SEQ ID NO: 1414 | LLIYAASSLQ SEQ ID NO: 1415 | QQSYSTPL SEQ ID NO: 1416 |
| Ab156 | SSYAMS SEQ ID NO: 1417 | WVSYISGNAYIS SEQ ID NO: 1418 | ARVPYGVWMD SEQ ID NO: 1419 | SSYAAWY SEQ ID NO: 1420 | LLIYGNTSRQ SEQ ID NO: 1421 | QQYSNSPL SEQ ID NO: 1422 |
| Ab63 | SSYSMH SEQ ID NO: 1423 | WVASISGSTGTSY SEQ ID NO: 1424 | ARVPYGYWID SEQ ID NO: 1425 | SSYLNWY SEQ ID NO: 1426 | LLIYAASSLQ SEQ ID NO: 1427 | QQSYSTPL SEQ ID NO: 1428 |
| Ab11 | SSYGMH SEQ ID NO: 1429 | WVASISSNGGYTS SEQ ID NO: 1430 | ARVPYGYWID SEQ ID NO: 1431 | SSYLNWY SEQ ID NO: 1432 | LLIYAASSLQ SEQ ID NO: 1433 | QQSYSTPL SEQ ID NO: 1434 |
| Ab182 | SSYSMH SEQ ID NO: 1435 | WVASISSNTGTTG SEQ ID NO: 1436 | ARVPYGYWID SEQ ID NO: 1437 | SSYLNWY SEQ ID NO: 1438 | LLIYAASSLQ SEQ ID NO: 1439 | QQSYSTPL SEQ ID NO: 1440 |
| Ab89 | SSYAMH SEQ ID NO: 1441 | WVTSISSSTGYIS SEQ ID NO: 1442 | ARVPYGYWID SEQ ID NO: 1443 | SSYLNWY SEQ ID NO: 1444 | LLIYAASSLQ SEQ ID NO: 1445 | QQSYSTPL SEQ ID NO: 1446 |
| Ab8 | SSYAMS SEQ ID NO: 1447 | WVADIKSNGGYTY SEQ ID NO: 1448 | ARVPYGYWLD SEQ ID NO: 1449 | SSYLNWY SEQ ID NO: 1450 | LLIYAASSLQ SEQ ID NO: 1451 | QQSYSTPL SEQ ID NO: 1452 |
| Ab101 | SSYAMS SEQ ID NO: 1453 | WVADISGSAGTIS SEQ ID NO: 1454 | ARVPYGYWLD SEQ ID NO: 1455 | SSYLNWY SEQ ID NO: 1456 | LLIYAASSLQ SEQ ID NO: 1457 | QQSYSTPL SEQ ID NO: 1458 |
| Ab25 | SSYGMH SEQ ID NO: 1459 | WVAAIKSSGSSTS SEQ ID NO: 1460 | ARVPYGYWMD SEQ ID NO: 1461 | SSYLNWY SEQ ID NO: 1462 | LLIYAASSLQ SEQ ID NO: 1463 | QQSYSTPL SEQ ID NO: 1464 |
| Ab154 | SSYSMH SEQ ID NO: 1465 | WVASIKSNTGTTG SEQ ID NO: 1466 | ARVPYGYWMD SEQ ID NO: 1467 | SSYLNWY SEQ ID NO: 1468 | LLIYAASSLQ SEQ ID NO: 1469 | QQSYSTPL SEQ ID NO: 1470 |
| Ab21 | SSYAMS SEQ ID NO: 1471 | WVSAISGSGGSTY SEQ ID NO: 1472 | ARVPYGYWMD SEQ ID NO: 1473 | SSYLNWY SEQ ID NO: 1474 | LLIYAASSLQ SEQ ID NO: 1475 | QQSYSTPL SEQ ID NO: 1476 |
| Ab111 | SSYSMH SEQ ID NO: 1477 | WVSAISGSGGSTY SEQ ID NO: 1478 | ARVPYGYWMD SEQ ID NO: 1479 | SSYLNWY SEQ ID NO: 1480 | LLIYAASSLQ SEQ ID NO: 1481 | QQSYSTPL SEQ ID NO: 1482 |
| Ab118 | SSYAMS SEQ ID NO: 1483 | WVSSINSNAGTSY SEQ ID NO: 1484 | ARVPYGYWMD SEQ ID NO: 1485 | SSYLNWY SEQ ID NO: 1486 | LLIYAASSLQ SEQ ID NO: 1487 | QQSYSTPL SEQ ID NO: 1488 |
| Ab173 | SSYAMS SEQ ID NO: 1489 | WVSSISSNTGTIS SEQ ID NO: 1490 | ARVPYGYWMD SEQ ID NO: 1491 | SSYLNWY SEQ ID NO: 1492 | LLIYAASSLQ SEQ ID NO: 1493 | QQSYSTPL SEQ ID NO: 1494 |
| Ab38 | SSYTMS | WVAGIWSDSGNKG | ARVPYSVWID | SSYLNWY | LLIYAASSLQ | QQSYSTPL |

FIG. 3L (ARV) CDRs

| clone | HCDR1 | HCDR2 | HCDR3 | LCDR1 | LCDR2 | LCDR3 |
|---|---|---|---|---|---|---|
| Ab76 | SEQ ID NO: 1495 DSYSMH SEQ ID NO: 1501 | SEQ ID NO: 1496 WVSAISGSGGSTY SEQ ID NO: 1502 | SEQ ID NO: 1497 ARVPYSVWID SEQ ID NO: 1503 | SEQ ID NO: 1498 SYYLNWY SEQ ID NO: 1504 | SEQ ID NO: 1499 LLIYAASSLQ SEQ ID NO: 1505 | SEQ ID NO: 1500 QQSYSTPL SEQ ID NO: 1506 |
| Ab131 | SSYAMS SEQ ID NO: 1507 | WVSDIKSSAGSTS SEQ ID NO: 1508 | ARVPYSVWID SEQ ID NO: 1509 | SYYVNWY SEQ ID NO: 1510 | LLIYAASSLQ SEQ ID NO: 1511 | QQSYSTPL SEQ ID NO: 1512 |
| Ab1 | SSYAMH SEQ ID NO: 1513 SSYAMH SEQ ID NO: 1519 SSYAMH SEQ ID NO: 1593 | WVSGISSNGGSTS SEQ ID NO: 1514 WVSGISSNGGSTS SEQ ID NO: 1520 WVSGISSNGGSTS SEQ ID NO: 1594 | ARVPYSVWID SEQ ID NO: 1515 ARAPYSVWID SEQ ID NO: 1521 ARVPYSVWAD SEQ ID NO: 1595 | SSYLNWY SEQ ID NO: 1516 SSYLNWY SEQ ID NO: 1522 SSYLNWY SEQ ID NO: 1596 | LLIYAASSLQ SEQ ID NO: 1517 LLIYAASSLQ SEQ ID NO: 1523 LLIYAASSLQ SEQ ID NO: 1597 | QQSYSTPL SEQ ID NO: 1518 QQSYSTPL SEQ ID NO: 1524 QQSYSTPL SEQ ID NO: 1598 |
| Ab67 | SSYAMS SEQ ID NO: 1525 | WVASIKSSTGTTY SEQ ID NO: 1526 | ARVPYSVWLD SEQ ID NO: 1527 | SSYLNWY SEQ ID NO: 1528 | LLIYAASSLQ SEQ ID NO: 1529 | QQSYSTPL SEQ ID NO: 1530 |
| Ab70 | SSYAMN SEQ ID NO: 1531 | WVASISSNTGTIG SEQ ID NO: 1532 | ARVPYSVWLD SEQ ID NO: 1533 | SSYLNWY SEQ ID NO: 1534 | LLIYAASSLQ SEQ ID NO: 1535 | QQSYSTPL SEQ ID NO: 1536 |
| Ab170 | NSYAMH SEQ ID NO: 1537 | WVAYISGNAGSIY SEQ ID NO: 1538 | ARVPYSVWLD SEQ ID NO: 1539 | SYYLNWY SEQ ID NO: 1540 | LLIYAASSLQ SEQ ID NO: 1541 | QQSYSTPL SEQ ID NO: 1542 |
| Ab30 | SSYGMH SEQ ID NO: 1543 | WVASIKSNSGNTG SEQ ID NO: 1544 | ARVPYSVWMD SEQ ID NO: 1545 | SSYLNWY SEQ ID NO: 1546 | LLIYAASSLQ SEQ ID NO: 1547 | QQSYSTPL SEQ ID NO: 1548 |
| Ab93 | SSYAMS SEQ ID NO: 1549 | WVASISSSTGTIS SEQ ID NO: 1550 | ARVPYSVWMD SEQ ID NO: 1551 | SSYLNWY SEQ ID NO: 1552 | LLIYAASSLQ SEQ ID NO: 1553 | QQSYSTPL SEQ ID NO: 1554 |
| Ab142 | SSYSMH SEQ ID NO: 1555 | WVSAISGSGGSTY SEQ ID NO: 1556 | ARVPYSVWMD SEQ ID NO: 1557 | SSYLNWY SEQ ID NO: 1558 | LLIYAASSLQ SEQ ID NO: 1559 | QQSYSTPL SEQ ID NO: 1560 |
| Ab104 | SSYAMS SEQ ID NO: 1561 | WVSSISSSASYTG SEQ ID NO: 1562 | ARVPYSYWID SEQ ID NO: 1563 | SSYLNWY SEQ ID NO: 1564 | LLIYAASSLQ SEQ ID NO: 1565 | QQSYSTPL SEQ ID NO: 1566 |
| Ab112 | SSYAMS SEQ ID NO: 1567 | WVASISSNTGSIY SEQ ID NO: 1568 | ARVPYSYWLD SEQ ID NO: 1569 | SSYLNWY SEQ ID NO: 1570 | LLIYAASSLQ SEQ ID NO: 1571 | QQSYSTPL SEQ ID NO: 1572 |
| Ab35 | SSYGMH SEQ ID NO: 1573 | WVASISSSSGYKY SEQ ID NO: 1574 | ARVPYSYWMD SEQ ID NO: 1575 | SSYLNWY SEQ ID NO: 1576 | LLIYAASSLQ SEQ ID NO: 1577 | QQSYSTPL SEQ ID NO: 1578 |
| Ab126 | SSYAMH SEQ ID NO: 1579 | WVASISSSTGSIG SEQ ID NO: 1580 | ARVPYSYWMD SEQ ID NO: 1581 | SSYLNWY SEQ ID NO: 1582 | LLIYAASSLQ SEQ ID NO: 1583 | QQSYSTPL SEQ ID NO: 1584 |
| Ab125 | SSYSMH SEQ ID NO: 1585 | WVASIKGNAGTTY SEQ ID NO: 1586 | AKVPYDVWMD SEQ ID NO: 1587 | SSYLNWY SEQ ID NO: 1588 | LLIYAASSLQ SEQ ID NO: 1589 | QQSYSTPL SEQ ID NO: 1590 |

FIG. 4

T-cell immunoreceptor with Ig and ITIM domains precursor [Homo sapiens]
MRWCLLLIWAQGLRQAPLASGMMTGTIETTGNISAEKGGSIILQCHLSSTTAQVTQVNWEQQDQLLAICN
ADLGWHISPSFKDRVAPGPGLGLTLQSLTVNDTGEYFCIYHTYPDGTYTGRIFLEVLESSVAEHGARFQI
PLLGAMAATLVVICTAVIVVVALTRKKKALRIHSVEGDLRRKSAGQEEWSPSAPSPPGSCVQAEAAPAGL
CGEQRGEDCAELHDYFNVLSYRSLGNCSFFTETG (SEQ ID NO: 1591)

T-cell immunoreceptor with Ig and ITIM domains precursor [Mus musculus]
MHGWLLLVWVQGLIQAAFLATGATAGTIDTKRNISAEEGGSVILQCHFSSDTAEVTQVDWKQQDQLLAIY
SVDLGWHVASVFSDRVVPGPSLGLTFQSLTMNDTGEYFCTYHTYPGGIYKGRIFLKVQESSVAQFQTAPL
GGTMAAVLGLICLMVTGVTVLARKKSIRMHSIESGLGRTEAEPQEWNLRSLSSPGSPVQTQTAPAGPCGE
QAEDDYADPQEYFNVLSYRSLESFIAVSKTG (SEQ ID NO: 1592)

FIG. 5

$Z_1Z_2Z_3Z_4Z_5Z_6Z_7Z_8Z_9Z_{10}$ (SEQ ID NO: 1599)

$SSYX_4MX_6$ (SEQ ID NO: 1600)

$WVY_3Y_4IY_6Y_7Y_8Y_9Y_{10}Y_{11}Y_{12}Y_{13}$ (SEQ ID NO: 1601)

$ARZ_3PYZ_6Z_7WZ_9D$ (SEQ ID NO: 1602)

ANTIGEN BINDING MOLECULES TO TIGIT

PRIORITY AND CROSS REFERENCE TO RELATED APPLICATIONS

This application claims the benefit of U.S. Provisional Application No. 62/429,639, filed on Dec. 2, 2016, which is hereby incorporated by reference in its entirety.

ELECTRONIC SEQUENCE LISTING

The present application is being filed along with an Electronic Sequence Listing. The Electronic Sequence Listing is provided as a file entitled RPHAR001ASEQLIST.txt, created Nov. 30, 2017, which is 647,692 bytes in size. The information in the Electronic Sequence Listing is incorporated herein by reference in its entirety.

BACKGROUND

Field

The present invention relates to antigen binding molecules that bind to TIGIT and the use thereof.

Description of the Related Art

TIGIT (T cell immunoreceptor with Ig and ITIM domains) has been previously identified as a putative modulator of immune function (see, e.g., US patent publication no. US20040121370, incorporated herein by reference).

TIGIT is an immunomodulatory receptor expressed primarily on activated T cells and NK cells. TIGIT is also known as VSIG9; VSTM3; and WUCAM. Its structure shows one extracellular immunoglobulin domain, a type 1 transmembrane region and two ITIM motifs. TIGIT forms part of a co-stimulatory network that consists of positive (CD226) and negative (TIGIT) immunomodulatory receptors on T cells, and ligands expressed on APCs (CD155 and CD112).

The TIGIT protein includes an immunoreceptor tyrosine-based inhibition motif (ITIM) in its cytoplasmic tail domain. As with PD-1 and CTLA-4, the ITIM domain in the cytoplasmic region of TIGIT is predicted to recruit tyrosine phosphatases, such as SHP-1 and SHP-2, and subsequent de-phosphorylation of tyrosine residues with in the immunoreceptor tyrosine-base activation motifs (ITAM) on T cell receptor (TCR) subunits. Hence, ligation of TIGIT by receptor-ligands CD155 and CD112 expressed by tumor cells or TAMS may contribute to the suppression of TCR-signaling and T cell activation, which is involved in mounting effective anti-tumor immunity.

SUMMARY

Some embodiments provided herein relate to antigen binding molecules that bind to TIGIT and comprise one or more of the sequence and/or structural aspects outlined in FIGS. 2A-2R and 3A-3L.

In some embodiments, an isolated antigen binding molecule that competes for binding to human TIGIT with an antibody comprises any one or more of a CDR within any of SEQ ID NO. 1-SEQ ID NO: 97, SEQ ID NO: 195-SEQ ID NO: 209, SEQ ID NO: 225-SEQ ID NO: 310, SEQ ID NO: 98-SEQ ID NO: 194, SEQ ID NO: 210-SEQ ID NO: 224, or SEQ ID NO: 311-SEQ ID NO: 396 any of in FIGS. 2A, 2B, 2C, 2D, 2E, 2F, 2G, 2H, 2I, 2J, 2K, 2L, 2M, 2N, 2O, 2P, 2Q, 2R, 3A, 3B, 3C, 3D, 3E,3F, 3G, 3H, 3I, 3J, 3K, or 3L.

In some embodiments, an isolated antigen binding molecule that binds to human TIGIT comprises: (a) a heavy chain CDR1 comprising the amino acid sequence of any one of the HCDR1s in SEQ ID NO: 397, SEQ ID NO: 403. SEQ ID NO: 409, SEQ ID NO: 415, SEQ ID NO: 421, SEQ ID NO: 427, SEQ ID NO: 433, SEQ ID NO: 439, SEQ ID NO: 445, SEQ ID NO: 451, SEQ ID NO: 457, SEQ ID NO: 463, SEQ ID NO: 469, SEQ ID NO: 475, SEQ ID NO: 481, SEQ ID NO: 487, SEQ ID NO: 493, SEQ ID NO: 499, SEQ ID NO: 505, SEQ ID NO: 511, SEQ ID NO: 517, SEQ ID NO: 523, SEQ ID NO: 529, SEQ ID NO: 535, SEQ ID NO: 541, SEQ ID NO: 547, SEQ ID NO: 553, SEQ ID NO: 559, SEQ ID NO: 565, SEQ ID NO: 571, SEQ ID NO: 577, SEQ ID NO: 583, SEQ ID NO: 589, SEQ ID NO: 595, SEQ ID NO: 601, SEQ ID NO: 607, SEQ ID NO: 613, SEQ ID NO: 619, SEQ ID NO: 625, SEQ ID NO: 631, SEQ ID NO: 637, SEQ ID NO: 643, SEQ ID NO: 649, SEQ ID NO: 655, SEQ ID NO: 661, SEQ ID NO: 667, SEQ ID NO: 673, SEQ ID NO: 679, SEQ ID NO: 685, SEQ ID NO: 691, SEQ ID NO: 697, SEQ ID NO: 703, SEQ ID NO: 709, SEQ ID NO: 715, SEQ ID NO: 721, SEQ ID NO: 727, SEQ ID NO: 733, SEQ ID NO: 739, SEQ ID NO: 745, SEQ ID NO: 751, SEQ ID NO: 757, SEQ ID NO: 763, SEQ ID NO: 769, SEQ ID NO: 775, SEQ ID NO: 781, SEQ ID NO: 787, SEQ ID NO: 793, SEQ ID NO: 799, SEQ ID NO: 805, SEQ ID NO: 811, SEQ ID NO: 817, SEQ ID NO: 823, SEQ ID NO: 829, SEQ ID NO: 835, SEQ ID NO: 841, SEQ ID NO: 847, SEQ ID NO: 853, SEQ ID NO: 859, SEQ ID NO: 865, SEQ ID NO: 871, SEQ ID NO: 877, SEQ ID NO: 883, SEQ ID NO: 889, SEQ ID NO: 895, SEQ ID NO: 901, SEQ ID NO: 907, SEQ ID NO: 913, SEQ ID NO: 919, SEQ ID NO: 925, SEQ ID NO: 931, SEQ ID NO: 937, SEQ ID NO: 943, SEQ ID NO: 949, SEQ ID NO: 955, SEQ ID NO: 961, SEQ ID NO: 967, SEQ ID NO: 973, SEQ ID NO: 979, SEQ ID NO: 985, SEQ ID NO: 991, SEQ ID NO: 997, SEQ ID NO: 1003, SEQ ID NO: 1009, SEQ ID NO: 1015, SEQ ID NO: 1021, SEQ ID NO: 1027, SEQ ID NO: 1033, SEQ ID NO: 1039, SEQ ID NO: 1045, SEQ ID NO: 1051, SEQ ID NO: 1057, SEQ ID NO: 1063, SEQ ID NO: 1069, SEQ ID NO: 1075, SEQ ID NO: 1081, SEQ ID NO: 1087, SEQ ID NO: 1093, SEQ ID NO: 1099, SEQ ID NO: 1105, SEQ ID NO: 1111, SEQ ID NO: 1117, SEQ ID NO: 1123, SEQ ID NO: 1129, SEQ ID NO: 1135, SEQ ID NO: 1141, SEQ ID NO: 1147, SEQ ID NO: 1153, SEQ ID NO: 1159, SEQ ID NO: 1165, SEQ ID NO: 1171, SEQ ID NO: 1177, SEQ ID NO: 1183, SEQ ID NO: 1189, SEQ ID NO: 1195, SEQ ID NO: 1201, SEQ ID NO: 1207, SEQ ID NO: 1213, SEQ ID NO: 1219, SEQ ID NO: 1225, SEQ ID NO: 1231, SEQ ID NO: 1237, SEQ ID NO: 1243, SEQ ID NO: 1249, SEQ ID NO: 1255, SEQ ID NO: 1261, SEQ ID NO: 1267, SEQ ID NO: 1273, SEQ ID NO: 1279, SEQ ID NO: 1285, SEQ ID NO: 1291, SEQ ID NO: 1297, SEQ ID NO: 1303, SEQ ID NO: 1309, SEQ ID NO: 1315, SEQ ID NO: 1321, SEQ ID NO: 1327, SEQ ID NO: 1333, SEQ ID NO: 1339, SEQ ID NO: 1345, SEQ ID NO: 1351, SEQ ID NO: 1357, SEQ ID NO: 1363, SEQ ID NO: 1369, SEQ ID NO: 1375, SEQ ID NO: 1381, SEQ ID NO: 1387, SEQ ID NO: 1393, SEQ ID NO: 1399, SEQ ID NO: 1405, SEQ ID NO: 1411, SEQ ID NO: 1417, SEQ ID NO: 1423, SEQ ID NO: 1429, SEQ ID NO: 1435, SEQ ID NO: 1441, SEQ ID NO: 1447, SEQ ID NO: 1453, SEQ ID NO: 1459, SEQ ID NO: 1465, SEQ ID NO: 1471, SEQ ID NO: 1477, SEQ ID NO: 1483, SEQ ID NO: 1489, SEQ ID NO: 1495, SEQ ID NO: 1501, SEQ ID NO: 1507, SEQ ID NO: 1513, SEQ ID NO: 1519, SEQ ID NO: 1593, SEQ ID NO: 1525 SEQ ID NO: 1531, SEQ ID NO: 1537, SEQ ID NO:

1543, SEQ ID NO: 1549, SEQ ID NO: 1555, SEQ ID NO: 1561, SEQ ID NO: 1567, SEQ ID NO: 1573, SEQ ID NO: 1579, or SEQ ID NO: 1585 in FIGS. 3A, 3B, 3C, 3D, 3E, 3F, 3G, 3H, 3I, 3J, 3K, or 3L; (b) a heavy chain CDR2 comprising the amino acid sequence of any one of the HCDR2s in SEQ ID NO: 398, SEQ ID NO: 404, SEQ ID NO: 410, SEQ ID NO: 416, SEQ ID NO: 422, SEQ ID NO: 428, SEQ ID NO: 434, SEQ ID NO: 440, SEQ ID NO: 446, SEQ ID NO: 452, SEQ ID NO: 458, SEQ ID NO: 464, SEQ ID NO: 470, SEQ ID NO: 476, SEQ ID NO: 482, SEQ ID NO: 488, SEQ ID NO: 494, SEQ ID NO: 500, SEQ ID NO: 506, SEQ ID NO: 512, SEQ ID NO: 518, SEQ ID NO: 524, SEQ ID NO: 530, SEQ ID NO: 536, SEQ ID NO: 542, SEQ ID NO: 548, SEQ ID NO: 554, SEQ ID NO: 560, SEQ ID NO: 566, SEQ ID NO: 572, SEQ ID NO: 578, SEQ ID NO: 584, SEQ ID NO: 590, SEQ ID NO: 596, SEQ ID NO: 602, SEQ ID NO: 608, SEQ ID NO: 614, SEQ ID NO: 620, SEQ ID NO: 626, SEQ ID NO: 632, SEQ ID NO: 638, SEQ ID NO: 644, SEQ ID NO: 650, SEQ ID NO: 656, SEQ ID NO: 662, SEQ ID NO: 668, SEQ ID NO: 674, SEQ ID NO: 680, SEQ ID NO: 686, SEQ ID NO: 692, SEQ ID NO: 698, SEQ ID NO: 704, SEQ ID NO: 710, SEQ ID NO: 716, SEQ ID NO: 722, SEQ ID NO: 728, SEQ ID NO: 734, SEQ ID NO: 740, SEQ ID NO: 746, SEQ ID NO: 752, SEQ ID NO: 758, SEQ ID NO: 764, SEQ ID NO: 770, SEQ ID NO: 776, SEQ ID NO: 782, SEQ ID NO: 788, SEQ ID NO: 794, SEQ ID NO: 800, SEQ ID NO: 806, SEQ ID NO: 812, SEQ ID NO: 818, SEQ ID NO: 824, SEQ ID NO: 830, SEQ ID NO: 836, SEQ ID NO: 842, SEQ ID NO: 848, SEQ ID NO: 854, SEQ ID NO: 860, SEQ ID NO: 866, SEQ ID NO: 872, SEQ ID NO: 878, SEQ ID NO: 884, SEQ ID NO: 890, SEQ ID NO: 896, SEQ ID NO: 902, SEQ ID NO: 908, SEQ ID NO: 914, SEQ ID NO: 920, SEQ ID NO: 926, SEQ ID NO: 932, SEQ ID NO: 938, SEQ ID NO: 944, SEQ ID NO: 950, SEQ ID NO: 956, SEQ ID NO: 962, SEQ ID NO: 968, SEQ ID NO: 974, SEQ ID NO: 980, SEQ ID NO: 986, SEQ ID NO: 992, SEQ ID NO: 998, SEQ ID NO: 1004, SEQ ID NO: 1010, SEQ ID NO: 1016, SEQ ID NO: 1022, SEQ ID NO: 1028, SEQ ID NO: 1034, SEQ ID NO: 1040, SEQ ID NO: 1046, SEQ ID NO: 1052, SEQ ID NO: 1058, SEQ ID NO: 1064, SEQ ID NO: 1070, SEQ ID NO: 1076, SEQ ID NO: 1082, SEQ ID NO: 1088, SEQ ID NO: 1094, SEQ ID NO: 1100, SEQ ID NO: 1106, SEQ ID NO: 1112, SEQ ID NO: 1118, SEQ ID NO: 1124, SEQ ID NO: 1130, SEQ ID NO: 1136, SEQ ID NO: 1142, SEQ ID NO: 1148, SEQ ID NO: 1154, SEQ ID NO: 1160, SEQ ID NO: 1166, SEQ ID NO: 1172, SEQ ID NO: 1178, SEQ ID NO: 1184, SEQ ID NO: 1190, SEQ ID NO: 1196, SEQ ID NO: 1202, SEQ ID NO: 1208, SEQ ID NO: 1214, SEQ ID NO: 1220, SEQ ID NO: 1226, SEQ ID NO: 1232, SEQ ID NO: 1238, SEQ ID NO: 1244, SEQ ID NO: 1250, SEQ ID NO: 1256, SEQ ID NO: 1262, SEQ ID NO: 1268, SEQ ID NO: 1274, SEQ ID NO: 1280, SEQ ID NO: 1286, SEQ ID NO: 1292, SEQ ID NO: 1298, SEQ ID NO: 1304, SEQ ID NO: 1310, SEQ ID NO: 1316, SEQ ID NO: 1322, SEQ ID NO: 1328, SEQ ID NO: 1334, SEQ ID NO: 1340, SEQ ID NO: 1346, SEQ ID NO: 1352, SEQ ID NO: 1358, SEQ ID NO: 1364, SEQ ID NO: 1370, SEQ ID NO: 1376, SEQ ID NO: 1382, SEQ ID NO: 1388, SEQ ID NO: 1394, SEQ ID NO: 1400, SEQ ID NO: 1406, SEQ ID NO: 1412, SEQ ID NO: 1418, SEQ ID NO: 1424, SEQ ID NO: 1430, SEQ ID NO: 1436, SEQ ID NO: 1442, SEQ ID NO: 1448, SEQ ID NO: 1454, SEQ ID NO: 1460, SEQ ID NO: 1466, SEQ ID NO: 1472, SEQ ID NO: 1478, SEQ ID NO: 1484, SEQ ID NO: 1490, SEQ ID NO: 1496, SEQ ID NO: 1502, SEQ ID NO: 1508, SEQ ID NO: 1514, SEQ ID NO: 1520, SEQ ID NO: 1594, SEQ ID NO: 1526, SEQ ID NO: 1532, SEQ ID NO: 1538, SEQ ID NO: 1544, SEQ ID NO: 1550, SEQ ID NO: 1556, SEQ ID NO: 1562, SEQ ID NO: 1568, SEQ ID NO: 1574, SEQ ID NO: 1580, or SEQ ID NO: 1586 in FIGS. 3A, 3B, 3C, 3D, 3E, 3F, 3G, 3H, 3I, 3J, 3K, or 3L; and (c) a heavy chain CDR3 comprising the amino acid sequence of any one of the HCDR3s in SEQ ID NO: 399, SEQ ID NO: 405, SEQ ID NO: 411, SEQ ID NO: 417, SEQ ID NO: 423, SEQ ID NO: 429, SEQ ID NO: 435, SEQ ID NO: 441, SEQ ID NO: 447, SEQ ID NO: 453, SEQ ID NO: 459, SEQ ID NO: 465, SEQ ID NO: 471, SEQ ID NO: 477, SEQ ID NO: 483, SEQ ID NO: 489, SEQ ID NO: 495, SEQ ID NO: 501, SEQ ID NO: 507, SEQ ID NO: 513, SEQ ID NO: 519, SEQ ID NO: 525, SEQ ID NO: 531, SEQ ID NO: 537, SEQ ID NO: 543, SEQ ID NO: 549, SEQ ID NO: 555, SEQ ID NO: 561, SEQ ID NO: 567, SEQ ID NO: 573, SEQ ID NO: 579, SEQ ID NO: 585, SEQ ID NO: 591, SEQ ID NO: 597, SEQ ID NO: 603, SEQ ID NO: 609, SEQ ID NO: 615, SEQ ID NO: 621, SEQ ID NO: 627, SEQ ID NO: 633, SEQ ID NO: 639, SEQ ID NO: 645, SEQ ID NO: 651, SEQ ID NO: 657, SEQ ID NO: 663, SEQ ID NO: 669, SEQ ID NO: 675, SEQ ID NO: 681, SEQ ID NO: 687, SEQ ID NO: 693, SEQ ID NO: 699, SEQ ID NO: 705, SEQ ID NO: 711, SEQ ID NO: 717, SEQ ID NO: 723, SEQ ID NO: 729, SEQ ID NO: 735, SEQ ID NO: 741, SEQ ID NO: 747, SEQ ID NO: 753, SEQ ID NO: 759, SEQ ID NO: 765, SEQ ID NO: 771, SEQ ID NO: 777, SEQ ID NO: 783, SEQ ID NO: 789, SEQ ID NO: 795, SEQ ID NO: 801, SEQ ID NO: 807, SEQ ID NO: 813, SEQ ID NO: 819, SEQ ID NO: 825, SEQ ID NO: 831, SEQ ID NO: 837, SEQ ID NO: 843, SEQ ID NO: 849, SEQ ID NO: 855, SEQ ID NO: 861, SEQ ID NO: 867, SEQ ID NO: 873, SEQ ID NO: 879, SEQ ID NO: 885, SEQ ID NO: 891, SEQ ID NO: 897, SEQ ID NO: 903, SEQ ID NO: 909, SEQ ID NO: 915, SEQ ID NO: 921, SEQ ID NO: 927, SEQ ID NO: 933, SEQ ID NO: 939, SEQ ID NO: 945, SEQ ID NO: 951, SEQ ID NO: 957, SEQ ID NO: 963, SEQ ID NO: 969, SEQ ID NO: 975, SEQ ID NO: 981, SEQ ID NO: 987, SEQ ID NO: 993, SEQ ID NO: 999, SEQ ID NO: 1005, SEQ ID NO: 1011, SEQ ID NO: 1017, SEQ ID NO: 1023, SEQ ID NO: 1029, SEQ ID NO: 1035, SEQ ID NO: 1041, SEQ ID NO: 1047, SEQ ID NO: 1053, SEQ ID NO: 1059, SEQ ID NO: 1065, SEQ ID NO: 1071, SEQ ID NO: 1077, SEQ ID NO: 1083, SEQ ID NO: 1089, SEQ ID NO: 1095, SEQ ID NO: 1101, SEQ ID NO: 1107, SEQ ID NO: 1113, SEQ ID NO: 1119, SEQ ID NO: 1125, SEQ ID NO: 1131, SEQ ID NO: 1137, SEQ ID NO: 1143, SEQ ID NO: 1149, SEQ ID NO: 1155, SEQ ID NO: 1161, SEQ ID NO: 1167, SEQ ID NO: 1173, SEQ ID NO: 1179, SEQ ID NO: 1185, SEQ ID NO: 1191, SEQ ID NO: 1197, SEQ ID NO: 1203, SEQ ID NO: 1209, SEQ ID NO: 1215, SEQ ID NO: 1221, SEQ ID NO: 1227, SEQ ID NO: 1233, SEQ ID NO: 1239, SEQ ID NO: 1245, SEQ ID NO: 1251, SEQ ID NO: 1257, SEQ ID NO: 1263, SEQ ID NO: 1269, SEQ ID NO: 1275, SEQ ID NO: 1281, SEQ ID NO: 1287, SEQ ID NO: 1293, SEQ ID NO: 1299, SEQ ID NO: 1305, SEQ ID NO: 1311, SEQ ID NO: 1317, SEQ ID NO: 1323, SEQ ID NO: 1329, SEQ ID NO: 1335, SEQ ID NO: 1341, SEQ ID NO: 1347, SEQ ID NO: 1353, SEQ ID NO: 1359, SEQ ID NO: 1365, SEQ ID NO: 1371, SEQ ID NO: 1377, SEQ ID NO: 1383, SEQ ID NO: 1389, SEQ ID NO: 1395, SEQ ID NO: 1401, SEQ ID NO: 1407, SEQ ID NO: 1413, SEQ ID NO: 1419, SEQ ID NO: 1425, SEQ ID NO: 1431, SEQ ID NO: 1437, SEQ ID NO: 1443, SEQ ID NO: 1449, SEQ ID NO: 1455, SEQ ID NO: 1461, SEQ ID NO: 1467, SEQ ID NO: 1473, SEQ ID NO: 1479, SEQ ID NO: 1485, SEQ ID NO: 1491, SEQ ID NO: 1497, SEQ ID NO: 1503, SEQ ID NO: 1509, SEQ ID NO: 1515, SEQ ID NO: 1521, SEQ ID NO: 1595, SEQ ID NO: 1527, SEQ ID NO: 1533, SEQ ID NO: 1539, SEQ ID NO: 1545, SEQ ID NO: 1551, SEQ ID NO: 1557, SEQ ID NO: 1563, SEQ ID NO: 1569, SEQ ID NO: 1575, SEQ ID NO: 1581, or SEQ ID NO: 1587 in FIGS. 3A, 3B, 3C, 3D, 3E, 3F, 3G, 3H, 3I, 3J, 3K, or 3L, wherein the HCDR1, HCDR2, and HCDR3 are from a same clone.

In some embodiments, an isolated antigen binding molecule that binds to human TIGIT comprises: (a) a heavy chain CDR1 comprising the amino acid sequence of any of one of the HCDR1s in SEQ ID NO: 397, SEQ ID NO: 403. SEQ ID NO: 409, SEQ ID NO: 415, SEQ ID NO: 421, SEQ ID NO: 427, SEQ ID NO: 433, SEQ ID NO: 439, SEQ ID NO: 445, SEQ ID NO: 451, SEQ ID NO: 457, SEQ ID NO: 463, SEQ ID NO: 469, SEQ ID NO: 475, SEQ ID NO: 481, SEQ ID NO: 487, SEQ ID NO: 493, SEQ ID NO: 499, SEQ ID NO: 505, SEQ ID NO: 511, SEQ ID NO: 517, SEQ ID NO: 523, SEQ ID NO: 529, SEQ ID NO: 535, SEQ ID NO: 541, SEQ ID NO: 547, SEQ ID NO: 553, SEQ ID NO: 559, SEQ ID NO: 565, SEQ ID NO: 571, SEQ ID NO: 577, SEQ ID NO: 583, SEQ ID NO: 589, SEQ ID NO: 595, SEQ ID NO: 601, SEQ ID NO: 607, SEQ ID NO: 613, SEQ ID NO: 619, SEQ ID NO: 625, SEQ ID NO: 631, SEQ ID NO: 637, SEQ ID NO: 643, SEQ ID NO: 649, SEQ ID NO: 655, SEQ ID NO: 661, SEQ ID NO: 667, SEQ ID NO: 673, SEQ ID NO: 679, SEQ ID NO: 685, SEQ ID NO: 691, SEQ ID NO: 697, SEQ ID NO: 703, SEQ ID NO: 709, SEQ ID NO: 715, SEQ ID NO: 721, SEQ ID NO: 727, SEQ ID NO: 733, SEQ ID NO: 739, SEQ ID NO: 745, SEQ ID NO: 751, SEQ ID NO: 757, SEQ ID NO: 763, SEQ ID NO: 769, SEQ ID NO: 775, SEQ ID NO: 781, SEQ ID NO: 787, SEQ ID NO: 793, SEQ ID NO: 799, SEQ ID NO: 805, SEQ ID NO: 811, SEQ ID NO: 817, SEQ ID NO: 823, SEQ ID NO: 829, SEQ ID NO: 835, SEQ ID NO: 841, SEQ ID NO: 847, SEQ ID NO: 853, SEQ ID NO: 859, SEQ ID NO: 865, SEQ ID NO: 871, SEQ ID NO: 877, SEQ ID NO: 883, SEQ ID NO: 889, SEQ ID NO: 895, SEQ ID NO: 901, SEQ ID NO: 907, SEQ ID NO: 913, SEQ ID NO: 919, SEQ ID NO: 925, SEQ ID NO: 931, SEQ ID NO: 937, SEQ ID NO: 943, SEQ ID NO: 949, SEQ ID NO: 955, SEQ ID NO: 961, SEQ ID NO: 967, SEQ ID NO: 973, SEQ ID NO: 979, SEQ ID NO: 985, SEQ ID NO: 991, SEQ ID NO: 997, SEQ ID NO: 1003, SEQ ID NO: 1009, SEQ ID NO: 1015, SEQ ID NO: 1021, SEQ ID NO: 1027, SEQ ID NO: 1033, SEQ ID NO: 1039, SEQ ID NO: 1045, SEQ ID NO: 1051, SEQ ID NO: 1057, SEQ ID NO: 1063, SEQ ID NO: 1069, SEQ ID NO: 1075, SEQ ID NO: 1081, SEQ ID NO: 1087, SEQ ID NO: 1093, SEQ ID NO: 1099, SEQ ID NO: 1105, SEQ ID NO: 1111, SEQ ID NO: 1117, SEQ ID NO: 1123, SEQ ID NO: 1129, SEQ ID NO: 1135, SEQ ID NO: 1141, SEQ ID NO: 1147, SEQ ID NO: 1153, SEQ ID NO: 1159, SEQ ID NO: 1165, SEQ ID NO: 1171, SEQ ID NO: 1177, SEQ ID NO: 1183, SEQ ID NO: 1189, SEQ ID NO: 1195, SEQ ID NO: 1201, SEQ ID NO: 1207, SEQ ID NO: 1213, SEQ ID NO: 1219, SEQ ID NO: 1225, SEQ ID NO: 1231, SEQ ID NO: 1237, SEQ ID NO: 1243, SEQ ID NO: 1249, SEQ ID NO: 1255, SEQ ID NO: 1261, SEQ ID NO: 1267, SEQ ID NO: 1273, SEQ ID NO: 1279, SEQ ID NO: 1285, SEQ ID NO: 1291, SEQ ID NO: 1297, SEQ ID NO: 1303, SEQ ID NO: 1309, SEQ ID NO: 1315, SEQ ID NO: 1321, SEQ ID NO: 1327, SEQ ID NO: 1333, SEQ ID NO: 1339, SEQ ID NO: 1345, SEQ ID NO: 1351, SEQ ID NO: 1357, SEQ ID NO: 1363, SEQ ID NO: 1369, SEQ ID NO: 1375, SEQ ID NO: 1381, SEQ ID NO: 1387, SEQ ID NO: 1393, SEQ ID NO: 1399, SEQ ID NO: 1405, SEQ ID NO: 1411, SEQ ID NO: 1417, SEQ ID NO: 1423, SEQ ID NO: 1429, SEQ ID NO: 1435, SEQ ID NO: 1441, SEQ ID NO: 1447, SEQ ID NO: 1453, SEQ ID NO: 1459, SEQ ID NO: 1465, SEQ ID NO: 1471, SEQ ID NO: 1477, SEQ ID NO: 1483, SEQ ID NO: 1489, SEQ ID NO: 1495, SEQ ID NO: 1501, SEQ ID NO: 1507, SEQ ID NO: 1513, SEQ ID NO: 1519, SEQ ID NO: 1593, SEQ ID NO: 1525 SEQ ID NO: 1531, SEQ ID NO: 1537, SEQ ID NO: 1543, SEQ ID NO: 1549, SEQ ID NO: 1555, SEQ ID NO: 1561, SEQ ID NO: 1567, SEQ ID NO: 1573, SEQ ID NO: 1579, or SEQ ID NO: 1585 in FIG. 3A, 3B, 3C, 3D, 3E, 3F, 3G, 3H, 3I, 3J, 3K, or 3L; (b) a heavy chain CDR2 comprising the amino acid sequence of any one of the HCDR2s in SEQ ID NO: 398, SEQ ID NO: 404, SEQ ID NO: 410, SEQ ID NO: 416, SEQ ID NO: 422, SEQ ID NO: 428, SEQ ID NO: 434, SEQ ID NO: 440, SEQ ID NO: 446, SEQ ID NO: 452, SEQ ID NO: 458, SEQ ID NO: 464, SEQ ID NO: 470, SEQ ID NO: 476, SEQ ID NO: 482, SEQ ID NO: 488, SEQ ID NO: 494, SEQ ID NO: 500, SEQ ID NO: 506, SEQ ID NO: 512, SEQ ID NO: 518, SEQ ID NO: 524, SEQ ID NO: 530, SEQ ID NO: 536, SEQ ID NO: 542, SEQ ID NO: 548, SEQ ID NO: 554, SEQ ID NO: 560, SEQ ID NO: 566, SEQ ID NO: 572, SEQ ID NO: 578, SEQ ID NO: 584, SEQ ID NO: 590, SEQ ID NO: 596, SEQ ID NO: 602, SEQ ID NO: 608, SEQ ID NO: 614, SEQ ID NO: 620, SEQ ID NO: 626, SEQ ID NO: 632, SEQ ID NO: 638, SEQ ID NO: 644, SEQ ID NO: 650, SEQ ID NO: 656, SEQ ID NO: 662, SEQ ID NO: 668, SEQ ID NO: 674, SEQ ID NO: 680, SEQ ID NO: 686, SEQ ID NO: 692, SEQ ID NO: 698, SEQ ID NO: 704, SEQ ID NO: 710, SEQ ID NO: 716, SEQ ID NO: 722, SEQ ID NO: 728, SEQ ID NO: 734, SEQ ID NO: 740, SEQ ID NO: 746, SEQ ID NO: 752, SEQ ID NO: 758, SEQ ID NO: 764, SEQ ID NO: 770, SEQ ID NO: 776, SEQ ID NO: 782, SEQ ID NO: 788, SEQ ID NO: 794, SEQ ID NO: 800, SEQ ID NO: 806, SEQ ID NO: 812, SEQ ID NO: 818, SEQ ID NO: 824, SEQ ID NO: 830, SEQ ID NO: 836, SEQ ID NO: 842, SEQ ID NO: 848, SEQ ID NO: 854, SEQ ID NO: 860, SEQ ID NO: 866, SEQ ID NO: 872, SEQ ID NO: 878, SEQ ID NO: 884, SEQ ID NO: 890, SEQ ID NO: 896, SEQ ID NO: 902, SEQ ID NO: 908, SEQ ID NO: 914, SEQ ID NO: 920, SEQ ID NO: 926, SEQ ID NO: 932, SEQ ID NO: 938, SEQ ID NO: 944, SEQ ID NO: 950, SEQ ID NO: 956, SEQ ID NO: 962, SEQ ID NO: 968, SEQ ID NO: 974, SEQ ID NO: 980, SEQ ID NO: 986, SEQ ID NO: 992, SEQ ID NO: 998, SEQ ID NO: 1004, SEQ ID NO: 1010, SEQ ID NO: 1016, SEQ ID NO: 1022, SEQ ID NO: 1028, SEQ ID NO: 1034, SEQ ID NO: 1040, SEQ ID NO: 1046, SEQ ID NO: 1052, SEQ ID NO: 1058, SEQ ID NO: 1064, SEQ ID NO: 1070, SEQ ID NO: 1076, SEQ ID NO: 1082, SEQ ID NO: 1088, SEQ ID NO: 1094, SEQ ID NO: 1100, SEQ ID NO: 1106, SEQ ID NO: 1112, SEQ ID NO: 1118, SEQ ID NO: 1124, SEQ ID NO: 1130, SEQ ID NO: 1136, SEQ ID NO: 1142, SEQ ID NO: 1148, SEQ ID NO: 1154, SEQ ID NO: 1160, SEQ ID NO: 1166, SEQ ID NO: 1172, SEQ ID NO: 1178, SEQ ID NO: 1184, SEQ ID NO: 1190, SEQ ID NO: 1196, SEQ ID NO: 1202, SEQ ID NO: 1208, SEQ ID NO: 1214, SEQ ID NO: 1220, SEQ ID NO: 1226, SEQ ID NO: 1232, SEQ ID NO: 1238, SEQ ID NO: 1244, SEQ ID NO: 1250, SEQ ID NO: 1256, SEQ ID NO: 1262, SEQ ID NO: 1268, SEQ ID NO: 1274, SEQ ID NO: 1280, SEQ ID NO: 1286, SEQ ID NO: 1292, SEQ ID NO: 1298, SEQ ID NO: 1304, SEQ ID NO: 1310, SEQ ID NO: 1316, SEQ ID NO: 1322, SEQ ID NO: 1328, SEQ ID NO: 1334, SEQ ID NO: 1340, SEQ ID NO: 1346, SEQ ID NO: 1352, SEQ ID NO: 1358, SEQ ID NO: 1364, SEQ ID NO: 1370, SEQ ID NO: 1376, SEQ ID NO: 1382, SEQ ID NO: 1388, SEQ ID NO: 1394, SEQ ID NO: 1400, SEQ ID NO: 1406, SEQ ID NO: 1412, SEQ ID NO: 1418, SEQ ID NO: 1424, SEQ ID NO: 1430, SEQ ID NO: 1436, SEQ ID NO: 1442, SEQ ID NO: 1448, SEQ ID NO: 1454, SEQ ID NO: 1460, SEQ ID NO: 1466, SEQ ID NO: 1472, SEQ ID NO: 1478, SEQ ID NO: 1484, SEQ ID NO: 1490, SEQ ID NO: 1496, SEQ ID NO: 1502, SEQ ID NO: 1508, SEQ ID NO: 1514, SEQ ID NO: 1520, SEQ ID NO: 1594, SEQ ID NO: 1526, SEQ ID NO: 1532, SEQ ID NO: 1538, SEQ ID NO: 1544, SEQ ID NO: 1550, SEQ ID NO: 1556, SEQ ID NO: 1562, SEQ ID NO: 1568, SEQ ID NO: 1574, SEQ ID NO: 1580, or SEQ ID NO: 1586 in FIGS. 3A, 3B, 3C, 3D, 3E, 3F, 3G, 3H, 3I, 3J, 3K, or 3L; (c) a heavy chain CDR3 comprising the amino acid sequence of any one of the HCDR3s in SEQ ID NO: 399, SEQ ID NO: 405, SEQ ID NO: 411, SEQ ID NO: 417, SEQ ID NO: 423, SEQ ID NO: 429, SEQ ID NO: 435, SEQ ID NO: 441, SEQ ID NO: 447, SEQ ID NO: 453, SEQ ID NO: 459, SEQ ID NO: 465, SEQ ID NO: 471, SEQ ID NO: 477, SEQ ID NO: 483, SEQ ID NO: 489, SEQ ID NO: 495, SEQ ID NO: 501, SEQ ID NO: 507, SEQ ID NO: 513, SEQ ID NO: 519, SEQ ID NO: 525, SEQ ID NO: 531, SEQ ID NO: 537, SEQ ID NO: 543, SEQ ID NO: 549, SEQ ID NO: 555, SEQ ID NO: 561, SEQ ID NO: 567, SEQ ID NO: 573, SEQ ID NO: 579, SEQ ID NO: 585, SEQ ID NO: 591, SEQ ID NO: 597, SEQ ID NO: 603, SEQ ID NO: 609, SEQ ID NO: 615, SEQ ID NO: 621, SEQ ID NO: 627, SEQ ID NO: 633, SEQ ID NO: 639, SEQ ID NO: 645, SEQ ID NO: 651, SEQ ID NO: 657, SEQ ID NO: 663, SEQ ID NO: 669, SEQ ID NO: 675, SEQ ID NO: 681, SEQ ID NO: 687, SEQ ID NO: 693, SEQ ID NO: 699, SEQ ID NO: 705, SEQ ID NO: 711, SEQ ID NO: 717, SEQ ID NO: 723, SEQ ID NO: 729, SEQ ID NO: 735, SEQ ID NO: 741, SEQ ID NO: 747, SEQ ID NO: 753, SEQ ID NO: 759, SEQ ID NO: 765, SEQ ID NO: 771, SEQ ID NO: 777, SEQ ID NO: 783, SEQ ID NO: 789, SEQ ID NO: 795, SEQ ID NO: 801, SEQ ID NO: 807, SEQ ID NO: 813, SEQ ID NO: 819, SEQ ID NO: 825, SEQ ID NO: 831, SEQ ID NO: 837, SEQ ID NO: 843, SEQ ID NO: 849, SEQ ID NO: 855, SEQ ID NO: 861, SEQ ID NO: 867, SEQ ID NO: 873, SEQ ID NO: 879, SEQ ID NO: 885, SEQ ID NO: 891, SEQ ID NO: 897, SEQ ID NO: 903, SEQ ID NO: 909, SEQ ID NO: 915, SEQ ID NO: 921, SEQ ID NO: 927, SEQ ID NO: 933, SEQ ID NO: 939, SEQ ID NO: 945, SEQ ID NO: 951, SEQ ID NO: 957, SEQ ID NO: 963, SEQ ID NO: 969, SEQ ID NO: 975, SEQ ID NO: 981, SEQ ID NO: 987, SEQ ID NO: 993, SEQ ID NO: 999, SEQ ID NO: 1005, SEQ ID NO: 1011, SEQ ID NO: 1017, SEQ ID NO: 1023, SEQ ID NO: 1029, SEQ ID NO: 1035, SEQ ID NO: 1041, SEQ ID NO: 1047, SEQ ID NO: 1053, SEQ ID NO: 1059, SEQ ID NO: 1065, SEQ ID NO: 1071, SEQ ID NO: 1077, SEQ ID NO: 1083, SEQ ID NO: 1089, SEQ ID NO: 1095, SEQ ID NO: 1101, SEQ ID NO: 1107, SEQ ID NO: 1113, SEQ ID NO: 1119, SEQ ID NO: 1125, SEQ ID NO: 1131, SEQ ID NO: 1137, SEQ ID NO: 1143, SEQ ID NO: 1149, SEQ ID NO: 1155, SEQ ID NO: 1161, SEQ ID NO: 1167, SEQ ID NO: 1173, SEQ ID NO: 1179, SEQ ID NO: 1185, SEQ ID NO: 1191, SEQ ID NO: 1197, SEQ ID NO: 1203, SEQ ID NO: 1209, SEQ ID NO: 1215, SEQ ID NO: 1221, SEQ ID NO: 1227, SEQ ID NO: 1233, SEQ ID NO: 1239, SEQ ID NO: 1245, SEQ ID NO: 1251, SEQ ID NO: 1257, SEQ ID NO: 1263, SEQ ID NO: 1269, SEQ ID NO: 1275, SEQ ID NO: 1281, SEQ ID NO: 1287, SEQ ID NO: 1293, SEQ ID NO: 1299, SEQ ID NO: 1305, SEQ ID NO: 1311, SEQ ID NO: 1317, SEQ ID NO: 1323, SEQ ID NO: 1329, SEQ ID NO: 1335, SEQ ID NO: 1341, SEQ ID NO: 1347, SEQ ID NO: 1353, SEQ ID NO: 1359, SEQ ID NO: 1365, SEQ ID NO: 1371, SEQ ID NO: 1377, SEQ ID NO: 1383, SEQ ID NO: 1389, SEQ ID NO: 1395, SEQ ID NO: 1401, SEQ ID NO: 1407, SEQ ID NO: 1413, SEQ ID NO: 1419, SEQ ID NO: 1425, SEQ ID NO: 1431, SEQ ID NO: 1437, SEQ ID NO: 1443, SEQ ID NO: 1449, SEQ ID NO: 1455, SEQ ID NO: 1461, SEQ ID NO: 1467, SEQ ID NO: 1473, SEQ ID NO: 1479, SEQ ID NO: 1485, SEQ ID NO: 1491, SEQ ID NO: 1497, SEQ ID NO: 1503, SEQ ID NO: 1509, SEQ ID NO: 1515, SEQ ID NO: 1521, SEQ ID NO: 1595, SEQ ID NO: 1527, SEQ ID NO: 1533, SEQ ID NO: 1539, SEQ ID NO: 1545, SEQ ID NO: 1551, SEQ ID NO: 1557, SEQ ID NO: 1563, SEQ ID NO: 1569, SEQ ID NO: 1575, SEQ ID NO: 1581, or SEQ ID NO: 1587 in FIG. 3A, 3B, 3C, 3D, 3E, 3F, 3G, 3H, 3I, 3J, 3K, or 3L; (d) a light chain CDR1 comprising the amino acid sequence of any one of the LCDR1s in SEQ ID NO: 400, SEQ ID NO: 406, SEQ ID NO: 412, SEQ ID NO: 418, SEQ ID NO: 424, SEQ ID NO: 430, SEQ ID NO: 436, SEQ ID NO: 442, SEQ ID NO: 448, SEQ ID NO: 454, SEQ ID NO: 460, SEQ ID NO: 466, SEQ ID NO: 472, SEQ ID NO: 478, SEQ ID NO: 484, SEQ ID NO: 490, SEQ ID NO: 496, SEQ ID NO: 502, SEQ ID NO: 508, SEQ ID NO: 514, SEQ ID NO: 520, SEQ ID NO: 526, SEQ ID NO: 532, SEQ ID NO: 538, SEQ ID NO: 544, SEQ ID NO: 550, SEQ ID NO: 556, SEQ ID NO: 562, SEQ ID NO: 568, SEQ ID NO: 574, SEQ ID NO: 580, SEQ ID NO: 586, SEQ ID NO: 592, SEQ ID NO: 598, SEQ ID NO: 604, SEQ ID NO: 610, SEQ ID NO: 616, SEQ ID NO: 622, SEQ ID NO: 628, SEQ ID NO: 634, SEQ ID NO: 640, SEQ ID NO: 646, SEQ ID NO: 652, SEQ ID NO: 658, SEQ ID NO: 664, SEQ ID NO: 670, SEQ ID NO: 676, SEQ ID NO: 682, SEQ ID NO: 688, SEQ ID NO: 694, SEQ ID NO: 700, SEQ ID NO: 706, SEQ ID NO: 712, SEQ ID NO: 718, SEQ ID NO: 724, SEQ ID NO: 730, SEQ ID NO: 736, SEQ ID NO: 742, SEQ ID NO: 748, SEQ ID NO: 754, SEQ ID NO: 760, SEQ ID NO: 766, SEQ ID NO: 772, SEQ ID NO: 778, SEQ ID NO: 784, SEQ ID NO: 790, SEQ ID NO: 796, SEQ ID NO: 802, SEQ ID NO: 808, SEQ ID NO: 814, SEQ ID NO: 820, SEQ ID NO: 826, SEQ ID NO: 832, SEQ ID NO: 838, SEQ ID NO: 844, SEQ ID NO: 850, SEQ ID NO: 856, SEQ ID NO: 862, SEQ ID NO: 868, SEQ ID NO: 874, SEQ ID NO: 880, SEQ ID NO: 886, SEQ ID NO: 892, SEQ ID NO: 898, SEQ ID NO: 904, SEQ ID NO: 910, SEQ ID NO: 916, SEQ ID NO: 922, SEQ ID NO: 928, SEQ ID NO: 934, SEQ ID NO: 940, SEQ ID NO: 946, SEQ ID NO: 952, SEQ ID NO: 958, SEQ ID NO: 964, SEQ ID NO: 970, SEQ ID NO: 976, SEQ ID NO: 982, SEQ ID NO: 988, SEQ ID NO: 994, SEQ ID NO: 1000, SEQ ID NO: 1006, SEQ ID NO: 1012, SEQ ID NO: 1018, SEQ ID NO: 1024, SEQ ID NO: 1030, SEQ ID NO: 1036, SEQ ID NO: 1042, SEQ ID NO: 1048, SEQ ID NO: 1054, SEQ ID NO: 1060, SEQ ID NO: 1066, SEQ ID NO: 1072, SEQ ID NO: 1078, SEQ ID NO: 1084, SEQ ID NO: 1090, SEQ ID NO: 1096, SEQ ID NO: 1102, SEQ ID NO: 1108, SEQ ID NO: 1114, SEQ ID NO: 1120, SEQ ID NO: 1126, SEQ ID NO: 1132, SEQ ID NO: 1138, SEQ ID NO: 1144, SEQ ID NO: 1150, SEQ ID NO: 1156, SEQ ID NO: 1162, SEQ ID NO: 1168, SEQ ID NO: 1174, SEQ ID NO: 1180, SEQ ID NO: 1186, SEQ ID NO: 1192, SEQ ID NO: 1198, SEQ ID NO: 1204, SEQ ID NO: 1210, SEQ ID NO: 1216, SEQ ID NO: 1222, SEQ ID NO: 1228, SEQ ID NO: 1234, SEQ ID NO: 1240, SEQ ID NO: 1246, SEQ ID NO: 1252, SEQ ID NO: 1258, SEQ ID NO: 1264, SEQ ID NO: 1270, SEQ ID NO: 1276, SEQ ID NO: 1282, SEQ ID NO: 1288, SEQ ID NO: 1294, SEQ ID NO: 1300, SEQ ID NO: 1306, SEQ ID NO: 1312, SEQ ID NO: 1318, SEQ ID NO: 1324, SEQ ID NO: 1330, SEQ ID NO: 1336, SEQ ID NO: 1342, SEQ ID NO: 1348, SEQ ID NO: 1354, SEQ ID NO: 1360, SEQ ID NO: 1366, SEQ ID NO: 1372, SEQ ID NO: 1378, SEQ ID NO: 1384, SEQ ID NO: 1390, SEQ ID NO: 1396, SEQ ID NO: 1402, SEQ ID NO: 1408, SEQ ID NO: 1414, SEQ ID NO: 1420, SEQ ID NO: 1426, SEQ ID NO: 1432, SEQ ID NO: 1438, SEQ ID NO: 1444, SEQ ID NO: 1450. SEQ ID NO: 1456, SEQ ID NO: 1462, SEQ ID NO: 1468, SEQ ID NO: 1474, SEQ ID NO: 1480, SEQ ID NO: 1486, SEQ ID NO: 1492, SEQ ID NO: 1498, SEQ ID NO: 1504, SEQ ID NO: 1510, SEQ ID NO: 1516, SEQ ID NO: 1522, SEQ ID NO: 1596, SEQ ID NO: 1528, SEQ ID NO: 1534, SEQ ID NO: 1540, SEQ ID NO: 1546, SEQ ID NO: 1552, SEQ ID NO: 1558, SEQ ID NO: 1564, SEQ ID NO: 1570, SEQ ID NO: 1576, SEQ ID NO: 1582, or SEQ ID NO: 1588 in FIG. 3A, 3B, 3C, 3D, 3E, 3F, 3G, 3H, 3I, 3J, 3K, or 3L; (e) a light chain CDR2 comprising the amino acid sequence of any one of the LCDR2s in SEQ ID NO: 401, SEQ ID NO: 407, SEQ ID NO: 413, SEQ ID NO: 419, SEQ ID NO: 425, SEQ ID NO: 431, SEQ ID NO: 437, SEQ ID NO: 443, SEQ ID NO: 449, SEQ ID NO: 455, SEQ ID NO: 461, SEQ ID NO: 467, SEQ ID NO: 473, SEQ ID NO: 479, SEQ ID NO: 485, SEQ ID NO: 491, SEQ ID NO: 497, SEQ ID NO: 503, SEQ ID NO: 509, SEQ ID NO: 515, SEQ ID NO: 521, SEQ ID NO: 527, SEQ ID NO: 533, SEQ ID NO: 539, SEQ ID NO: 545, SEQ ID NO: 551, SEQ ID NO: 557, SEQ ID NO: 563, SEQ ID NO: 569, SEQ ID NO: 575, SEQ ID NO: 581, SEQ ID NO: 587, SEQ ID NO: 593, SEQ ID NO: 599, SEQ ID NO: 605, SEQ ID NO: 611, SEQ ID NO: 617, SEQ ID NO: 623, SEQ ID NO: 629, SEQ ID NO: 635, SEQ ID NO: 641, SEQ ID NO: 647, SEQ ID NO: 653, SEQ ID NO: 659, SEQ ID NO: 665, SEQ ID NO: 671, SEQ ID NO: 677, SEQ ID NO: 683, SEQ ID NO: 689, SEQ ID NO: 695, SEQ ID NO: 701, SEQ ID NO: 707, SEQ ID NO: 713, SEQ ID NO: 719, SEQ ID NO: 725, SEQ ID NO: 731, SEQ ID NO: 737, SEQ ID NO: 743, SEQ ID NO: 749, SEQ ID NO: 755, SEQ ID NO: 761, SEQ ID NO: 767, SEQ ID NO: 773, SEQ ID NO: 779, SEQ ID NO: 785, SEQ ID NO: 791, SEQ ID NO: 797, SEQ ID NO: 803, SEQ ID NO: 809, SEQ ID NO: 815, SEQ ID NO: 821, SEQ ID NO: 827, SEQ ID NO: 833, SEQ ID NO: 839, SEQ ID NO: 845, SEQ ID NO: 851, SEQ ID NO: 857, SEQ ID NO: 863, SEQ ID NO: 869, SEQ ID NO: 875, SEQ ID NO: 881, SEQ ID NO: 887, SEQ ID NO: 893, SEQ ID NO: 899, SEQ ID NO: 905, SEQ ID NO: 911, SEQ ID NO: 917, SEQ ID NO: 923, SEQ ID NO: 929, SEQ ID NO: 935, SEQ ID NO: 941, SEQ ID NO: 947, SEQ ID NO: 953, SEQ ID NO: 959, SEQ ID NO: 965, SEQ ID NO: 971, SEQ ID NO: 977, SEQ ID NO: 983, SEQ ID NO: 989, SEQ ID NO: 995, SEQ ID NO: 1001, SEQ ID NO: 1007, SEQ ID NO: 1013, SEQ ID NO: 1019, SEQ ID NO: 1025, SEQ ID NO: 1031, SEQ ID NO: 1037, SEQ ID NO: 1043, SEQ ID NO: 1049, SEQ ID NO: 1055, SEQ ID NO: 1061, SEQ ID NO: 1067, SEQ ID NO: 1073, SEQ ID NO: 1079, SEQ ID NO: 1085, SEQ ID NO: 1091, SEQ ID NO: 1097, SEQ ID NO: 1103, SEQ ID NO: 1109, SEQ ID NO: 1115, SEQ ID NO: 1121, SEQ ID NO: 1127, SEQ ID NO: 1133, SEQ ID NO: 1139, SEQ ID NO: 1145, SEQ ID NO: 1151, SEQ ID NO: 1157, SEQ ID NO: 1163, SEQ ID NO: 1169, SEQ ID NO: 1175, SEQ ID NO: 1181, SEQ ID NO: 1187, SEQ ID NO: 1193, SEQ ID NO: 1199, SEQ ID NO: 1205, SEQ ID NO: 1211, SEQ ID NO: 1217, SEQ ID NO: 1223, SEQ ID NO: 1229, SEQ ID NO: 1235, SEQ ID NO: 1241, SEQ ID NO: 1247, SEQ ID NO: 1253, SEQ ID NO: 1259, SEQ ID NO: 1265, SEQ ID NO: 1271, SEQ ID NO: 1277, SEQ ID NO: 1283, SEQ ID NO: 1289, SEQ ID NO: 1295, SEQ ID NO: 1301, SEQ ID NO: 1307, SEQ ID NO: 1313, SEQ ID NO: 1319, SEQ ID NO: 1325, SEQ ID NO: 1331, SEQ ID NO: 1337, SEQ ID NO: 1343, SEQ ID NO: 1349, SEQ ID NO: 1355, SEQ ID NO: 1361, SEQ ID NO: 1367, SEQ ID NO: 1373, SEQ ID NO: 1379, SEQ ID NO: 1385, SEQ ID NO: 1391, SEQ ID NO: 1397, SEQ ID NO: 1403, SEQ ID NO: 1409, SEQ ID NO: 1415, SEQ ID NO: 1421, SEQ ID NO: 1427, SEQ ID NO: 1433, SEQ ID NO: 1439, SEQ ID NO: 1445, SEQ ID NO: 1451, SEQ ID NO: 1457, SEQ ID NO: 1463, SEQ ID NO: 1469, SEQ ID NO: 1475, SEQ ID NO: 1481, SEQ ID NO: 1487, SEQ ID NO: 1493, SEQ ID NO: 1499, SEQ ID NO: 1505, SEQ ID NO: 1511, SEQ ID NO: 1517, SEQ ID NO: 1523, SEQ ID NO: 1597, SEQ ID NO: 1529, SEQ ID NO: 1535, SEQ ID NO: 1541, SEQ ID NO: 1547, SEQ ID NO: 1553, SEQ ID NO: 1559, SEQ ID NO: 1565, SEQ ID NO: 1571, SEQ ID NO: 1577, SEQ ID NO: 1583, or SEQ ID NO: 1589 in FIGS. 3A, 3B, 3C, 3D, 3E, 3F, 3G, 3H, 3I, 3J, 3K, or 3L; and (f) a light chain CDR3 comprising the amino acid sequence of any one of the LCDR3s in SEQ ID NO: 402, SEQ ID NO: 408, SEQ ID NO: 414, SEQ ID NO: 420, SEQ ID NO: 426, SEQ ID NO: 432, SEQ ID NO: 438, SEQ ID NO: 444, SEQ ID NO: 450, SEQ ID NO: 456, SEQ ID NO: 462, SEQ ID NO: 468, SEQ ID NO: 474, SEQ ID NO: 480, SEQ ID NO: 486, SEQ ID NO: 492, SEQ ID NO: 498, SEQ ID NO: 504, SEQ ID NO: 510, SEQ ID NO: 516, SEQ ID NO: 522, SEQ ID NO: 528, SEQ ID NO: 534, SEQ ID NO: 540, SEQ ID NO: 546, SEQ ID NO: 552, SEQ ID NO: 558, SEQ ID NO: 564, SEQ ID NO: 570, SEQ ID NO: 576, SEQ ID NO: 582, SEQ ID NO: 588, SEQ ID NO: 594, SEQ ID NO: 600, SEQ ID NO: 606, SEQ ID NO: 612, SEQ ID NO: 618, SEQ ID NO: 624, SEQ ID NO: 630, SEQ ID NO: 636, SEQ ID NO: 642, SEQ ID NO: 648, SEQ ID NO: 654, SEQ ID NO: 660, SEQ ID NO: 666, SEQ ID NO: 672, SEQ ID NO: 678, SEQ ID NO: 684, SEQ ID NO: 690, SEQ ID NO: 696, SEQ ID NO: 702, SEQ ID NO: 708, SEQ ID NO: 714, SEQ ID NO: 720, SEQ ID NO: 726, SEQ ID NO: 732, SEQ ID NO: 738, SEQ ID NO: 744, SEQ ID NO: 750, SEQ ID NO: 756, SEQ ID NO: 762, SEQ ID NO: 768, SEQ ID NO: 774, SEQ ID NO: 780, SEQ ID NO: 786, SEQ ID NO: 792, SEQ ID NO: 798, SEQ ID NO: 804, SEQ ID NO: 810, SEQ ID NO: 816, SEQ ID NO: 822, SEQ ID NO: 828, SEQ ID NO: 834, SEQ ID NO: 840, SEQ ID NO: 846, SEQ ID NO: 852, SEQ ID NO: 858, SEQ ID NO: 864, SEQ ID NO: 870, SEQ ID NO: 876, SEQ ID NO: 882, SEQ ID NO: 888, SEQ ID NO: 894, SEQ ID NO: 900, SEQ ID NO: 906, SEQ ID NO: 912, SEQ ID NO: 918, SEQ ID NO: 924, SEQ ID NO: 930, SEQ ID NO: 936, SEQ ID NO: 942, SEQ ID NO: 948, SEQ ID NO: 954, SEQ ID NO: 960, SEQ ID NO: 966, SEQ ID NO: 972, SEQ ID NO: 978, SEQ ID NO: 984, SEQ ID NO: 990, SEQ ID NO: 996, SEQ ID NO: 1002, SEQ ID NO: 1008, SEQ ID NO: 1014, SEQ ID NO: 1020, SEQ ID NO: 1026, SEQ ID NO: 1032, SEQ ID NO: 1038, SEQ ID NO: 1044, SEQ ID NO: 1050, SEQ ID NO: 1056, SEQ ID NO: 1062, SEQ ID NO: 1068, SEQ ID NO: 1074, SEQ ID NO: 1080, SEQ ID NO: 1086, SEQ ID NO: 1092, SEQ ID NO: 1098, SEQ ID NO: 1104, SEQ ID NO: 1110, SEQ ID NO: 1116, SEQ ID NO: 1122, SEQ ID NO: 1128, SEQ ID NO: 1134, SEQ ID NO: 1140, SEQ ID NO: 1146, SEQ ID NO: 1152, SEQ ID NO: 1158, SEQ ID NO: 1164, SEQ ID NO: 1170, SEQ ID NO: 1176, SEQ ID NO: 1182, SEQ ID NO: 1188, SEQ ID NO: 1194, SEQ ID NO: 1200, SEQ ID NO: 1206, SEQ ID NO: 1212, SEQ ID NO: 1218, SEQ ID NO: 1224, SEQ ID NO: 1230, SEQ ID NO: 1236, SEQ ID NO: 1242, SEQ ID NO: 1248, SEQ ID NO: 1254, SEQ ID NO: 1260, SEQ ID NO: 1266, SEQ ID NO: 1272, SEQ ID NO: 1278, SEQ ID NO: 1284, SEQ ID NO: 1290, SEQ ID NO: 1296, SEQ ID NO: 1302, SEQ ID NO: 1308, SEQ ID NO: 1314, SEQ ID NO: 1320, SEQ ID NO: 1326, SEQ ID NO: 1332, SEQ ID NO: 1338, SEQ ID NO: 1344, SEQ ID NO: 1350, SEQ ID NO: 1356, SEQ ID NO: 1362, SEQ ID NO: 1368, SEQ ID NO: 1374, SEQ ID NO: 1380, SEQ ID NO: 1386, SEQ ID NO: 1392, SEQ ID NO: 1398, SEQ ID NO: 1404, SEQ ID NO: 1410, SEQ ID NO: 1416, SEQ ID NO: 1422, SEQ ID NO: 1428, SEQ ID NO: 1434, SEQ ID NO: 1440, SEQ ID NO: 1446, SEQ ID NO: 1452, SEQ ID NO: 1458, SEQ ID NO: 1464, SEQ ID NO: 1470, SEQ ID NO: 1476, SEQ ID NO: 1482, SEQ ID NO: 1488, SEQ ID NO: 1494, SEQ ID NO: 1500, SEQ ID NO: 1506, SEQ ID NO: 1512, SEQ ID NO: 1518, SEQ ID NO: 1524, SEQ ID NO: 1598, SEQ ID NO: 1530, SEQ ID NO: 1536, SEQ ID NO: 1542, SEQ ID NO: 1548, SEQ ID NO: 1554, SEQ ID NO: 1560, SEQ ID NO: 1566, SEQ ID NO: 1572, SEQ ID NO: 1578, SEQ ID NO: 1584, or SEQ ID NO: 1590 in FIGS. 3A, 3B, 3C, 3D, 3E, 3F, 3G, 3H, 3I, 3J, 3K, or 3L, wherein the HCDR1, HCDR2, HCDR3, LCDR1, LCDR2, and LCDR3 are from a same clone.

In some embodiments, an isolated antigen binding molecule that binds to human TIGIT comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 in FIGS. 2A, 2B, 2C, 2D, 2E, 2F, 2G, 2H, 2I, 2J, 2K, 2L, 2M, 2N, 2O, 2P, 2Q, or 2R.

In some embodiments, an isolated antigen binding molecule that binds to human TIGIT comprises a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 in FIGS. 2A, 2B, 2C, 2D, 2E, 2F, 2G, 2H, 2I, 2J, 2K, 2L, 2M, 2N, 2O, 2P, 2Q or 2R.

In some embodiments, an isolated antigen binding molecule that binds to human TIGIT comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 in FIGS. 2A, 2B, 2C, 2D, 2E, 2F, 2G, 2H, 2I, 2J, 2K, 2L, 2M, 2N, and a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 in FIGS. 2A, 2B, 2C, 2D, 2E, 2F, 2G, 2H, 2I, 2J, 2K, 2L, 2M, 2N, 2O, 2P, 2Q or 2R.

In some embodiments, an isolated antigen binding molecule that binds to human TIGIT comprises: a heavy chain CDR1 comprising $SSYX_4MX_6$ (SEQ ID NO: 1600) wherein $X_4$ is A, G, or S and $X_6$ is H, N, or S; a heavy chain CDR2 comprising $WVY_3Y_4IY_6Y_7Y_8Y_9Y_{10}Y_{11}Y_{12}Y_{13}$ (SEQ ID NO: 1601), wherein $Y_3$ is S or A, $Y_4$ is G, N, S, Y, or A, $Y_6$ is S, K, or N, $Y_7$ is S, Y, or G, $Y_8$ is N or S, $Y_9$ is G, S, A, or T, $Y_{10}$ is G or S, $Y_{11}$ is S, N, or T, $Y_{12}$ is T, K, S, or I, $Y_{13}$ is S, Y, or G; and a heavy chain CDR3 comprising $ARZ_3PYZ_6Z_7WZ_9D$ (SEQ ID NO: 1602), wherein $Z_3$ is V, A, G, or E, $Z_6$ is S, D, or G, $Z_7$ is V or Y, $Z_9$ is I, A, M, or L.

In some embodiments, an isolated binding molecule that binds to human TIGIT comprises at least one of: (a) (i) a heavy chain variable region comprising the amino acid sequence of SEQ ID NO: 23 and (ii) a light chain variable region comprising the amino acid sequence of SEQ ID NO: 120; (b) (i) a heavy chain variable region comprising the amino acid sequence of SEQ ID NO: 29 and (ii) a light chain variable region comprising the amino acid sequence of SEQ ID NO: 126; (c) (i) a heavy chain variable region comprising the amino acid sequence of SEQ ID NO: 45 and (ii) a light chain variable region comprising the amino acid sequence of SEQ ID NO: 142; (d) (i) a heavy chain variable region comprising the amino acid sequence of SEQ ID NO: 46 and (ii) a light chain variable region comprising the amino acid sequence of SEQ ID NO: 143; (e) (i) a heavy chain variable region comprising the amino acid sequence of SEQ ID NO: 58 and (ii) a light chain variable region comprising the amino acid sequence of SEQ ID NO: 155; (f) (i) a heavy chain variable region comprising the amino acid sequence of SEQ ID NO: 63 and (ii) a light chain variable region comprising the amino acid sequence of SEQ ID NO: 160; (g) (i) a heavy chain variable region comprising the amino acid sequence of SEQ ID NO: 67 and (ii) a light chain variable region comprising the amino acid sequence of SEQ ID NO: 164; (h) (i) a heavy chain variable region comprising the amino acid sequence of SEQ ID NO: 72 and (ii) a light chain variable region comprising the amino acid sequence of SEQ ID NO: 169; (i) (i) a heavy chain variable region comprising the amino acid sequence of SEQ ID NO: 80 and (ii) a light chain variable region comprising the amino acid sequence of SEQ ID NO: 177; or (j) (i) a heavy chain variable region that is at least 85% identical to any of the heavy chain variable regions in (a)-(i) and (ii) a light chain variable region that is at least 85% identical to any of the light chain variable regions in (a)-(i).

In some embodiments, an isolated antigen binding molecule that binds to human TIGIT comprises a heavy chain CDR3 of contiguous amino acids $Z_1Z_2Z_3Z_4Z_5Z_6Z_7Z_8Z_9Z_{10}$, (SEQ ID NO: 1599), wherein, $Z_1$ is A; $Z_2$ is R; $Z_3$ is E; $Z_4$ is P; $Z_5$ is Y; $Z_6$ is D, G, or S; $Z_7$ is V, Y, or T; $Z_8$ is W; $Z_9$ is I, L, or M; and $Z_{10}$ is D.

In some embodiments, an isolated antibody comprises: (a) a heavy chain CDR1 comprising the amino acid sequence of any of one of the HCDR1s in SEQ ID NO: 397, SEQ ID NO: 403. SEQ ID NO: 409, SEQ ID NO: 415, SEQ ID NO: 421, SEQ ID NO: 427, SEQ ID NO: 433, SEQ ID NO: 439, SEQ ID NO: 445, SEQ ID NO: 451, SEQ ID NO: 457, SEQ ID NO: 463, SEQ ID NO: 469, SEQ ID NO: 475, SEQ ID NO: 481, SEQ ID NO: 487, SEQ ID NO: 493, SEQ ID NO: 499, SEQ ID NO: 505, SEQ ID NO: 511, SEQ ID NO: 517, SEQ ID NO: 523, SEQ ID NO: 529, SEQ ID NO: 535, SEQ ID NO: 541, SEQ ID NO: 547, SEQ ID NO: 553, SEQ ID NO: 559, SEQ ID NO: 565, SEQ ID NO: 571, SEQ ID NO: 577, SEQ ID NO: 583, SEQ ID NO: 589, SEQ ID NO: 595, SEQ ID NO: 601, SEQ ID NO: 607, SEQ ID NO: 613, SEQ ID NO: 619, SEQ ID NO: 625, SEQ ID NO: 631, SEQ ID NO: 637, SEQ ID NO: 643, SEQ ID NO: 649, SEQ ID NO: 655, SEQ ID NO: 661, SEQ ID NO: 667, SEQ ID NO: 673, SEQ ID NO: 679, SEQ ID NO: 685, SEQ ID NO: 691, SEQ ID NO: 697, SEQ ID NO: 703, SEQ ID NO: 709, SEQ ID NO: 715, SEQ ID NO: 721, SEQ ID NO: 727, SEQ ID NO: 733, SEQ ID NO: 739, SEQ ID NO: 745, SEQ ID NO: 751, SEQ ID NO: 757, SEQ ID NO: 763, SEQ ID NO: 769, SEQ ID NO: 775, SEQ ID NO: 781, SEQ ID NO: 787, SEQ ID NO: 793, SEQ ID NO: 799, SEQ ID NO: 805, SEQ ID NO: 811, SEQ ID NO: 817, SEQ ID NO: 823, SEQ ID NO: 829, SEQ ID NO: 835, SEQ ID NO: 841, SEQ ID NO: 847, SEQ ID NO: 853, SEQ ID NO: 859, SEQ ID NO: 865, SEQ ID NO: 871, SEQ ID NO: 877, SEQ ID NO: 883, SEQ ID NO: 889, SEQ ID NO: 895, SEQ ID NO: 901, SEQ ID NO: 907, SEQ ID NO: 913, SEQ ID NO: 919, SEQ ID NO: 925, SEQ ID NO: 931, SEQ ID NO: 937, SEQ ID NO: 943, SEQ ID NO: 949, SEQ ID NO: 955, SEQ ID NO: 961, SEQ ID NO: 967, SEQ ID NO: 973, SEQ ID NO: 979, SEQ ID NO: 985, SEQ ID NO: 991, SEQ ID NO: 997, SEQ ID NO: 1003, SEQ ID NO: 1009, SEQ ID NO: 1015, SEQ ID NO: 1021, SEQ ID NO: 1027, SEQ ID NO: 1033, SEQ ID NO: 1039, SEQ ID NO: 1045, SEQ ID NO: 1051, SEQ ID NO: 1057, SEQ ID NO: 1063, SEQ ID NO: 1069, SEQ ID NO: 1075, SEQ ID NO: 1081, SEQ ID NO: 1087, SEQ ID NO: 1093, SEQ ID NO: 1099, SEQ ID NO: 1105, SEQ ID NO: 1111, SEQ ID NO: 1117, SEQ ID NO: 1123, SEQ ID NO: 1129, SEQ ID NO: 1135, SEQ ID NO: 1141, SEQ ID NO: 1147, SEQ ID NO: 1153, SEQ ID NO: 1159, SEQ ID NO: 1165, SEQ ID NO: 1171, SEQ ID NO: 1177, SEQ ID NO: 1183, SEQ ID NO: 1189, SEQ ID NO: 1195, SEQ ID NO: 1201, SEQ ID NO: 1207, SEQ ID NO: 1213, SEQ ID NO: 1219, SEQ ID NO: 1225, SEQ ID NO: 1231, SEQ ID NO: 1237, SEQ ID NO: 1243, SEQ ID NO: 1249, SEQ ID NO: 1255, SEQ ID NO: 1261, SEQ ID NO: 1267, SEQ ID NO: 1273, SEQ ID NO: 1279, SEQ ID NO: 1285, SEQ ID NO: 1291, SEQ ID NO: 1297, SEQ ID NO: 1303, SEQ ID NO: 1309, SEQ ID NO: 1315, SEQ ID NO: 1321, SEQ ID NO: 1327, SEQ ID NO: 1333, SEQ ID NO: 1339, SEQ ID NO: 1345, SEQ ID NO: 1351, SEQ ID NO: 1357, SEQ ID NO: 1363, SEQ ID NO: 1369, SEQ ID NO: 1375, SEQ ID NO: 1381, SEQ ID NO: 1387, SEQ ID NO: 1393, SEQ ID NO: 1399, SEQ ID NO: 1405, SEQ ID NO: 1411, SEQ ID NO: 1417, SEQ ID NO: 1423, SEQ ID NO: 1429, SEQ ID NO: 1435, SEQ ID NO: 1441, SEQ ID NO: 1447, SEQ ID NO: 1453, SEQ ID NO: 1459, SEQ ID NO: 1465, SEQ ID NO: 1471, SEQ ID NO: 1477, SEQ ID NO: 1483, SEQ ID NO: 1489, SEQ ID NO: 1495, SEQ ID NO: 1501, SEQ ID NO: 1507, SEQ ID NO: 1513, SEQ ID NO: 1519, SEQ ID NO: 1593, SEQ ID NO: 1525 SEQ ID NO: 1531, SEQ ID NO: 1537, SEQ ID NO: 1543, SEQ ID NO: 1549, SEQ ID NO: 1555, SEQ ID NO: 1561, SEQ ID NO: 1567, SEQ ID NO: 1573, SEQ ID NO: 1579, or SEQ ID NO: 1585 in FIGS. 3A, 3B, 3C, 3D, 3E, 3F, 3G, 3H, 3I, 3J, 3K, or 3L; (b) a heavy chain CDR2 comprising the amino acid sequence of any one of the HCDR2s in in SEQ ID NO: 398, SEQ ID NO: 404, SEQ ID NO: 410, SEQ ID NO: 416, SEQ ID NO: 422, SEQ ID NO: 428, SEQ ID NO: 434, SEQ ID NO: 440, SEQ ID NO: 446, SEQ ID NO: 452, SEQ ID NO: 458, SEQ ID NO: 464, SEQ ID NO: 470, SEQ ID NO: 476, SEQ ID NO: 482, SEQ ID NO: 488, SEQ ID NO: 494, SEQ ID NO: 500, SEQ ID NO: 506, SEQ ID NO: 512, SEQ ID NO: 518, SEQ ID NO: 524, SEQ ID NO: 530, SEQ ID NO: 536, SEQ ID NO: 542, SEQ ID NO: 548, SEQ ID NO: 554, SEQ ID NO: 560, SEQ ID NO: 566, SEQ ID NO: 572, SEQ ID NO: 578, SEQ ID NO: 584, SEQ ID NO: 590, SEQ ID NO: 596, SEQ ID NO: 602, SEQ ID NO: 608, SEQ ID NO: 614, SEQ ID NO: 620, SEQ ID NO: 626, SEQ ID NO: 632, SEQ ID NO: 638, SEQ ID NO: 644, SEQ ID NO: 650, SEQ ID NO: 656, SEQ ID NO: 662, SEQ ID NO: 668, SEQ ID NO: 674, SEQ ID NO: 680, SEQ ID NO: 686, SEQ ID NO: 692, SEQ ID NO: 698, SEQ ID NO: 704, SEQ ID NO: 710, SEQ ID NO: 716, SEQ ID NO: 722, SEQ ID NO: 728, SEQ ID NO: 734, SEQ ID NO: 740, SEQ ID NO: 746, SEQ ID NO: 752, SEQ ID NO: 758, SEQ ID NO: 764, SEQ ID NO: 770, SEQ ID NO: 776, SEQ ID NO: 782, SEQ ID NO: 788, SEQ ID NO: 794, SEQ ID NO: 800, SEQ ID NO: 806, SEQ ID NO: 812, SEQ ID NO: 818, SEQ ID NO: 824, SEQ ID NO: 830, SEQ ID NO: 836, SEQ ID NO: 842, SEQ ID NO: 848, SEQ ID NO: 854, SEQ ID NO: 860, SEQ ID NO: 866, SEQ ID NO: 872, SEQ ID NO: 878, SEQ ID NO: 884, SEQ ID NO: 890, SEQ ID NO: 896, SEQ ID NO: 902, SEQ ID NO: 908, SEQ ID NO: 914, SEQ ID NO: 920, SEQ ID NO: 926, SEQ ID NO: 932, SEQ ID NO: 938, SEQ ID NO: 944, SEQ ID NO: 950, SEQ ID NO: 956, SEQ ID NO: 962, SEQ ID NO: 968, SEQ ID NO: 974, SEQ ID NO: 980, SEQ ID NO: 986, SEQ ID NO: 992, SEQ ID NO: 998, SEQ ID NO: 1004, SEQ ID NO: 1010, SEQ ID NO: 1016, SEQ ID NO: 1022, SEQ ID NO: 1028, SEQ ID NO: 1034, SEQ ID NO: 1040, SEQ ID NO: 1046, SEQ ID NO: 1052, SEQ ID NO: 1058, SEQ ID NO: 1064, SEQ ID NO: 1070, SEQ ID NO: 1076, SEQ ID NO: 1082, SEQ ID NO: 1088, SEQ ID NO: 1094, SEQ ID NO: 1100, SEQ ID NO: 1106, SEQ ID NO: 1112, SEQ ID NO: 1118, SEQ ID NO: 1124, SEQ ID NO: 1130, SEQ ID NO: 1136, SEQ ID NO: 1142, SEQ ID NO: 1148, SEQ ID NO: 1154, SEQ ID NO: 1160, SEQ ID NO: 1166, SEQ ID NO: 1172, SEQ ID NO: 1178, SEQ ID NO: 1184, SEQ ID NO: 1190, SEQ ID NO: 1196, SEQ ID NO: 1202, SEQ ID NO: 1208, SEQ ID NO: 1214, SEQ ID NO: 1220, SEQ ID NO: 1226, SEQ ID NO: 1232, SEQ ID NO: 1238, SEQ ID NO: 1244, SEQ ID NO: 1250, SEQ ID NO: 1256, SEQ ID NO: 1262, SEQ ID NO: 1268, SEQ ID NO: 1274, SEQ ID NO: 1280, SEQ ID NO: 1286, SEQ ID NO: 1292, SEQ ID NO: 1298, SEQ ID NO: 1304, SEQ ID NO: 1310, SEQ ID NO: 1316, SEQ ID NO: 1322, SEQ ID NO: 1328, SEQ ID NO: 1334, SEQ ID NO: 1340, SEQ ID NO: 1346, SEQ ID NO: 1352, SEQ ID NO: 1358, SEQ ID NO: 1364, SEQ ID NO: 1370, SEQ ID NO: 1376, SEQ ID NO: 1382, SEQ ID NO: 1388, SEQ ID NO: 1394, SEQ ID NO: 1400, SEQ ID NO: 1406, SEQ ID NO: 1412, SEQ ID NO: 1418, SEQ ID NO: 1424, SEQ ID NO: 1430, SEQ ID NO: 1436, SEQ ID NO: 1442, SEQ ID NO: 1448, SEQ ID NO: 1454, SEQ ID NO: 1460, SEQ ID NO: 1466, SEQ ID NO: 1472, SEQ ID NO: 1478, SEQ ID NO: 1484, SEQ ID NO: 1490, SEQ ID NO: 1496, SEQ ID NO: 1502, SEQ ID NO: 1508, SEQ ID NO: 1514, SEQ ID NO: 1520, SEQ ID NO: 1594, SEQ ID NO: 1526, SEQ ID NO: 1532, SEQ ID NO: 1538, SEQ ID NO: 1544, SEQ ID NO: 1550, SEQ ID NO: 1556, SEQ ID NO: 1562, SEQ ID NO: 1568, SEQ ID NO: 1574, SEQ ID NO: 1580, or SEQ ID NO: 1586 in FIGS. 3A, 3B, 3C, 3D, 3E, 3F, 3G, 3H, 3I, 3J, 3K, or 3L; (c) a heavy chain CDR3 comprising the amino acid sequence of any one of the HCDR3s in SEQ ID NO: 399, SEQ ID NO: 405, SEQ ID NO: 411, SEQ ID NO: 417, SEQ ID NO: 423, SEQ ID NO: 429, SEQ ID NO: 435, SEQ ID NO: 441, SEQ ID NO: 447, SEQ ID NO: 453, SEQ ID NO: 459, SEQ ID NO: 465, SEQ ID NO: 471, SEQ ID NO: 477, SEQ ID NO: 483, SEQ ID NO: 489, SEQ ID NO: 495, SEQ ID NO: 501, SEQ ID NO: 507, SEQ ID NO: 513, SEQ ID NO: 519, SEQ ID NO: 525, SEQ ID NO: 531, SEQ ID NO: 537, SEQ ID NO: 543, SEQ ID NO: 549, SEQ ID NO: 555, SEQ ID NO: 561, SEQ ID NO: 567, SEQ ID NO: 573, SEQ ID NO: 579, SEQ ID NO: 585, SEQ ID NO: 591, SEQ ID NO: 597, SEQ ID NO: 603, SEQ ID NO: 609, SEQ ID NO: 615, SEQ ID NO: 621, SEQ ID NO: 627, SEQ ID NO: 633, SEQ ID NO: 639, SEQ ID NO: 645, SEQ ID NO: 651, SEQ ID NO: 657, SEQ ID NO: 663, SEQ ID NO: 669, SEQ ID NO: 675, SEQ ID NO: 681, SEQ ID NO: 687, SEQ ID NO: 693, SEQ ID NO: 699, SEQ ID NO: 705, SEQ ID NO: 711, SEQ ID NO: 717, SEQ ID NO: 723, SEQ ID NO: 729, SEQ ID NO: 735, SEQ ID NO: 741, SEQ ID NO: 747, SEQ ID NO: 753, SEQ ID NO: 759, SEQ ID NO: 765, SEQ ID NO: 771, SEQ ID NO: 777, SEQ ID NO: 783, SEQ ID NO: 789, SEQ ID NO: 795, SEQ ID NO: 801, SEQ ID NO: 807, SEQ ID NO: 813, SEQ ID NO: 819, SEQ ID NO: 825, SEQ ID NO: 831, SEQ ID NO: 837, SEQ ID NO: 843, SEQ ID NO: 849, SEQ ID NO: 855, SEQ ID NO: 861, SEQ ID NO: 867, SEQ ID NO: 873, SEQ ID NO: 879, SEQ ID NO: 885, SEQ ID NO: 891, SEQ ID NO: 897, SEQ ID NO: 903, SEQ ID NO: 909, SEQ ID NO: 915, SEQ ID NO: 921, SEQ ID NO: 927, SEQ ID NO: 933, SEQ ID NO: 939, SEQ ID NO: 945, SEQ ID NO: 951, SEQ ID NO: 957, SEQ ID NO: 963, SEQ ID NO: 969, SEQ ID NO: 975, SEQ ID NO: 981, SEQ ID NO: 987, SEQ ID NO: 993, SEQ ID NO: 999, SEQ ID NO: 1005, SEQ ID NO: 1011, SEQ ID NO: 1017, SEQ ID NO: 1023, SEQ ID NO: 1029, SEQ ID NO: 1035, SEQ ID NO: 1041, SEQ ID NO: 1047, SEQ ID NO: 1053, SEQ ID NO: 1059, SEQ ID NO: 1065, SEQ ID NO: 1071, SEQ ID NO: 1077, SEQ ID NO: 1083, SEQ ID NO: 1089, SEQ ID NO: 1095, SEQ ID NO: 1101, SEQ ID NO: 1107, SEQ ID NO: 1113, SEQ ID NO: 1119, SEQ ID NO: 1125, SEQ ID NO: 1131, SEQ ID NO: 1137, SEQ ID NO: 1143, SEQ ID NO: 1149, SEQ ID NO: 1155, SEQ ID NO: 1161, SEQ ID NO: 1167, SEQ ID NO: 1173, SEQ ID NO: 1179, SEQ ID NO: 1185, SEQ ID NO: 1191, SEQ ID NO: 1197, SEQ ID NO: 1203, SEQ ID NO: 1209, SEQ ID NO: 1215, SEQ ID NO: 1221, SEQ ID NO: 1227, SEQ ID NO: 1233, SEQ ID NO: 1239, SEQ ID NO: 1245, SEQ ID NO: 1251, SEQ ID NO: 1257, SEQ ID NO: 1263, SEQ ID NO: 1269, SEQ ID NO: 1275, SEQ ID NO: 1281, SEQ ID NO: 1287, SEQ ID NO: 1293, SEQ ID NO: 1299, SEQ ID NO: 1305, SEQ ID NO: 1311, SEQ ID NO: 1317, SEQ ID NO: 1323, SEQ ID NO: 1329, SEQ ID NO: 1335, SEQ ID NO: 1341, SEQ ID NO: 1347, SEQ ID NO: 1353, SEQ ID NO: 1359, SEQ ID NO: 1365, SEQ ID NO: 1371, SEQ ID NO: 1377, SEQ ID NO: 1383, SEQ ID NO: 1389, SEQ ID NO: 1395, SEQ ID NO: 1401, SEQ ID NO: 1407, SEQ ID NO: 1413, SEQ ID NO: 1419, SEQ ID NO: 1425, SEQ ID NO: 1431, SEQ ID NO: 1437, SEQ ID NO: 1443, SEQ ID NO: 1449, SEQ ID NO: 1455, SEQ ID NO: 1461, SEQ ID NO: 1467, SEQ ID NO: 1473, SEQ ID NO: 1479, SEQ ID NO: 1485, SEQ ID NO: 1491, SEQ ID NO: 1497, SEQ ID NO: 1503, SEQ ID NO: 1509, SEQ ID NO: 1515, SEQ ID NO: 1521, SEQ ID NO: 1595, SEQ ID NO: 1527, SEQ ID NO: 1533, SEQ ID NO: 1539, SEQ ID NO: 1545, SEQ ID NO: 1551, SEQ ID NO: 1557, SEQ ID NO: 1563, SEQ ID NO: 1569, SEQ ID NO: 1575, SEQ ID NO: 1581, or SEQ ID NO: 1587 in FIGS. 3A, 3B, 3C, 3D, 3E, 3F, 3G, 3H, 3I, 3J, 3K, or 3L; (d) a light chain CDR1 comprising the amino acid sequence of any one of the LCDR1s in SEQ ID NO: 400, SEQ ID NO: 406, SEQ ID NO: 412, SEQ ID NO: 418, SEQ ID NO: 424, SEQ ID NO: 430, SEQ ID NO: 436, SEQ ID NO: 442, SEQ ID NO: 448, SEQ ID NO: 454, SEQ ID NO: 460, SEQ ID NO: 466, SEQ ID NO: 472, SEQ ID NO: 478, SEQ ID NO: 484, SEQ ID NO: 490, SEQ ID NO: 496, SEQ ID NO: 502, SEQ ID NO: 508, SEQ ID NO: 514, SEQ ID NO: 520, SEQ ID NO: 526, SEQ ID NO: 532, SEQ ID NO: 538, SEQ ID NO: 544, SEQ ID NO: 550, SEQ ID NO: 556, SEQ ID NO: 562, SEQ ID NO: 568, SEQ ID NO: 574, SEQ ID NO: 580, SEQ ID NO: 586, SEQ ID NO: 592, SEQ ID NO: 598, SEQ ID NO: 604, SEQ ID NO: 610, SEQ ID NO: 616, SEQ ID NO: 622, SEQ ID NO: 628, SEQ ID NO: 634, SEQ ID NO: 640, SEQ ID NO: 646, SEQ ID NO: 652, SEQ ID NO: 658, SEQ ID NO: 664, SEQ ID NO: 670, SEQ ID NO: 676, SEQ ID NO: 682, SEQ ID NO: 688, SEQ ID NO: 694, SEQ ID NO: 700, SEQ ID NO: 706, SEQ ID NO: 712, SEQ ID NO: 718, SEQ ID NO: 724, SEQ ID NO: 730, SEQ ID NO: 736, SEQ ID NO: 742, SEQ ID NO: 748, SEQ ID NO: 754, SEQ ID NO: 760, SEQ ID NO: 766, SEQ ID NO: 772, SEQ ID NO: 778, SEQ ID NO: 784, SEQ ID NO: 790, SEQ ID NO: 796, SEQ ID NO: 802, SEQ ID NO: 808, SEQ ID NO: 814, SEQ ID NO: 820, SEQ ID NO: 826, SEQ ID NO: 832, SEQ ID NO: 838, SEQ ID NO: 844, SEQ ID NO: 850, SEQ ID NO: 856, SEQ ID NO: 862, SEQ ID NO: 868, SEQ ID NO: 874, SEQ ID NO: 880, SEQ ID NO: 886, SEQ ID NO: 892, SEQ ID NO: 898, SEQ ID NO: 904, SEQ ID NO: 910, SEQ ID NO: 916, SEQ ID NO: 922, SEQ ID NO: 928, SEQ ID NO: 934, SEQ ID NO: 940, SEQ ID NO: 946, SEQ ID NO: 952, SEQ ID NO: 958, SEQ ID NO: 964, SEQ ID NO: 970, SEQ ID NO: 976, SEQ ID NO: 982, SEQ ID NO: 988, SEQ ID NO: 994, SEQ ID NO: 1000, SEQ ID NO: 1006, SEQ ID NO: 1012, SEQ ID NO: 1018, SEQ ID NO: 1024, SEQ ID NO: 1030, SEQ ID NO: 1036, SEQ ID NO: 1042, SEQ ID NO: 1048, SEQ ID NO: 1054, SEQ ID NO: 1060, SEQ ID NO: 1066, SEQ ID NO: 1072, SEQ ID NO: 1078, SEQ ID NO: 1084, SEQ ID NO: 1090, SEQ ID NO: 1096, SEQ ID NO: 1102, SEQ ID NO: 1108, SEQ ID NO: 1114, SEQ ID NO: 1120, SEQ ID NO: 1126, SEQ ID NO: 1132, SEQ ID NO: 1138, SEQ ID NO: 1144, SEQ ID NO: 1150, SEQ ID NO: 1156, SEQ ID NO: 1162, SEQ ID NO: 1168, SEQ ID NO: 1174, SEQ ID NO: 1180, SEQ ID NO: 1186, SEQ ID NO: 1192, SEQ ID NO: 1198, SEQ ID NO: 1204, SEQ ID NO: 1210, SEQ ID NO: 1216, SEQ ID NO: 1222, SEQ ID NO: 1228, SEQ ID NO: 1234, SEQ ID NO: 1240, SEQ ID NO: 1246, SEQ ID NO: 1252, SEQ ID NO: 1258, SEQ ID NO: 1264, SEQ ID NO: 1270, SEQ ID NO: 1276, SEQ ID NO: 1282, SEQ ID NO: 1288, SEQ ID NO: 1294, SEQ ID NO: 1300, SEQ ID NO: 1306, SEQ ID NO: 1312, SEQ ID NO: 1318, SEQ ID NO: 1324, SEQ ID NO: 1330, SEQ ID NO: 1336, SEQ ID NO: 1342, SEQ ID NO: 1348, SEQ ID NO: 1354, SEQ ID NO: 1360, SEQ ID NO: 1366, SEQ ID NO: 1372, SEQ ID NO: 1378, SEQ ID NO: 1384, SEQ ID NO: 1390, SEQ ID NO: 1396, SEQ ID NO: 1402, SEQ ID NO: 1408, SEQ ID NO: 1414, SEQ ID NO: 1420, SEQ ID NO: 1426, SEQ ID NO: 1432, SEQ ID NO: 1438, SEQ ID NO: 1444, SEQ ID NO: 1450. SEQ ID NO: 1456, SEQ ID NO: 1462, SEQ ID NO: 1468, SEQ ID NO: 1474, SEQ ID NO: 1480, SEQ ID NO: 1486, SEQ ID NO: 1492, SEQ ID NO: 1498, SEQ ID NO: 1504, SEQ ID NO: 1510, SEQ ID NO: 1516, SEQ ID NO: 1522, SEQ ID NO: 1596, SEQ ID NO: 1528, SEQ ID NO: 1534, SEQ ID NO: 1540, SEQ ID NO: 1546, SEQ ID NO: 1552, SEQ ID NO: 1558, SEQ ID NO: 1564, SEQ ID NO: 1570, SEQ ID NO: 1576, SEQ ID NO: 1582, or SEQ ID NO: 1588 in FIGS. 3A, 3B, 3C, 3D, 3E, 3F, 3G, 3H, 3I, 3J, 3K, or 3L; (e) a light chain CDR2 comprising the amino acid sequence of any one of the LCDR2s in SEQ ID NO: 401, SEQ ID NO: 407, SEQ ID NO: 413, SEQ ID NO: 419, SEQ ID NO: 425, SEQ ID NO: 431, SEQ ID NO: 437, SEQ ID NO: 443, SEQ ID NO: 449, SEQ ID NO: 455, SEQ ID NO: 461, SEQ ID NO: 467, SEQ ID NO: 473, SEQ ID NO: 479, SEQ ID NO: 485, SEQ ID NO: 491, SEQ ID NO: 497, SEQ ID NO: 503, SEQ ID NO: 509, SEQ ID NO: 515, SEQ ID NO: 521, SEQ ID NO: 527, SEQ ID NO: 533, SEQ ID NO: 539, SEQ ID NO: 545, SEQ ID NO: 551, SEQ ID NO: 557, SEQ ID NO: 563, SEQ ID NO: 569, SEQ ID NO: 575, SEQ ID NO: 581, SEQ ID NO: 587, SEQ ID NO: 593, SEQ ID NO: 599, SEQ ID NO: 605, SEQ ID NO: 611, SEQ ID NO: 617, SEQ ID NO: 623, SEQ ID NO: 629, SEQ ID NO: 635, SEQ ID NO: 641, SEQ ID NO: 647, SEQ ID NO: 653, SEQ ID NO: 659, SEQ ID NO: 665, SEQ ID NO: 671, SEQ ID NO: 677, SEQ ID NO: 683, SEQ ID NO: 689, SEQ ID NO: 695, SEQ ID NO: 701, SEQ ID NO: 707, SEQ ID NO: 713, SEQ ID NO: 719, SEQ ID NO: 725, SEQ ID NO: 731, SEQ ID NO: 737, SEQ ID NO: 743, SEQ ID NO: 749, SEQ ID NO: 755, SEQ ID NO: 761, SEQ ID NO: 767, SEQ ID NO: 773, SEQ ID NO: 779, SEQ ID NO: 785, SEQ ID NO: 791, SEQ ID NO: 797, SEQ ID NO: 803, SEQ ID NO: 809, SEQ ID NO: 815, SEQ ID NO: 821, SEQ ID NO: 827, SEQ ID NO: 833, SEQ ID NO: 839, SEQ ID NO: 845, SEQ ID NO: 851, SEQ ID NO: 857, SEQ ID NO: 863, SEQ ID NO: 869, SEQ ID NO: 875, SEQ ID NO: 881, SEQ ID NO: 887, SEQ ID NO: 893, SEQ ID NO: 899, SEQ ID NO: 905, SEQ ID NO: 911, SEQ ID NO: 917, SEQ ID NO: 923, SEQ ID NO: 929, SEQ ID NO: 935, SEQ ID NO: 941, SEQ ID NO: 947, SEQ ID NO: 953, SEQ ID NO: 959, SEQ ID NO: 965, SEQ ID NO: 971, SEQ ID NO: 977, SEQ ID NO: 983, SEQ ID NO: 989, SEQ ID NO: 995, SEQ ID NO: 1001, SEQ ID NO: 1007, SEQ ID NO: 1013, SEQ ID NO: 1019, SEQ ID NO: 1025, SEQ ID NO: 1031, SEQ ID NO: 1037, SEQ ID NO: 1043, SEQ ID NO: 1049, SEQ ID NO: 1055, SEQ ID NO: 1061, SEQ ID NO: 1067, SEQ ID NO: 1073, SEQ ID NO: 1079, SEQ ID NO: 1085, SEQ ID NO: 1091, SEQ ID NO: 1097, SEQ ID NO: 1103, SEQ ID NO: 1109, SEQ ID NO: 1115, SEQ ID NO: 1121, SEQ ID NO: 1127, SEQ ID NO: 1133, SEQ ID NO: 1139, SEQ ID NO: 1145, SEQ ID NO: 1151, SEQ ID NO: 1157, SEQ ID NO: 1163, SEQ ID NO: 1169, SEQ ID NO: 1175, SEQ ID NO: 1181, SEQ ID NO: 1187, SEQ ID NO: 1193, SEQ ID NO: 1199, SEQ ID NO: 1205, SEQ ID NO: 1211, SEQ ID NO: 1217, SEQ ID NO: 1223, SEQ ID NO: 1229, SEQ ID NO: 1235, SEQ ID NO: 1241, SEQ ID NO: 1247, SEQ ID NO: 1253, SEQ ID NO: 1259, SEQ ID NO: 1265, SEQ ID NO: 1271, SEQ ID NO: 1277, SEQ ID NO: 1283, SEQ ID NO: 1289, SEQ ID NO: 1295, SEQ ID NO: 1301, SEQ ID NO: 1307, SEQ ID NO: 1313, SEQ ID NO: 1319, SEQ ID NO: 1325, SEQ ID NO: 1331, SEQ ID NO: 1337, SEQ ID NO: 1343, SEQ ID NO: 1349, SEQ ID NO: 1355, SEQ ID NO: 1361, SEQ ID NO: 1367, SEQ ID NO: 1373, SEQ ID NO: 1379, SEQ ID NO: 1385, SEQ ID NO: 1391, SEQ ID NO: 1397, SEQ ID NO: 1403, SEQ ID NO: 1409, SEQ ID NO: 1415, SEQ ID NO: 1421, SEQ ID NO: 1427, SEQ ID NO: 1433, SEQ ID NO: 1439, SEQ ID NO: 1445, SEQ ID NO: 1451, SEQ ID NO: 1457, SEQ ID NO: 1463, SEQ ID NO: 1469, SEQ ID NO: 1475, SEQ ID NO: 1481, SEQ ID NO: 1487, SEQ ID NO: 1493, SEQ ID NO: 1499, SEQ ID NO: 1505, SEQ ID NO: 1511, SEQ ID NO: 1517, SEQ ID NO: 1523, SEQ ID NO: 1597, SEQ ID NO: 1529, SEQ ID NO: 1535, SEQ ID NO: 1541, SEQ ID NO: 1547, SEQ ID NO: 1553, SEQ ID NO: 1559, SEQ ID NO: 1565, SEQ ID NO: 1571, SEQ ID NO: 1577, SEQ ID NO: 1583, or SEQ ID NO: 1589 in FIGS. 3A, 3B, 3C, 3D, 3E, 3F, 3G, 3H, 3I, 3J, 3K, or 3L; and (f) a light chain CDR3 comprising the amino acid sequence of any one of the LCDR3s in SEQ ID NO: 402, SEQ ID NO: 408, SEQ ID NO: 414, SEQ ID NO: 420, SEQ ID NO: 426, SEQ ID NO: 432, SEQ ID NO: 438, SEQ ID NO: 444, SEQ ID NO: 450, SEQ ID NO: 456, SEQ ID NO: 462, SEQ ID NO: 468, SEQ ID NO: 474, SEQ ID NO: 480, SEQ ID NO: 486, SEQ ID NO: 492, SEQ ID NO: 498, SEQ ID NO: 504, SEQ ID NO: 510, SEQ ID NO: 516, SEQ ID NO: 522, SEQ ID NO: 528, SEQ ID NO: 534, SEQ ID NO: 540, SEQ ID NO: 546, SEQ ID NO: 552, SEQ ID NO: 558, SEQ ID NO: 564, SEQ ID NO: 570, SEQ ID NO: 576, SEQ ID NO: 582, SEQ ID NO: 588, SEQ ID NO: 594, SEQ ID NO: 600, SEQ ID NO: 606, SEQ ID NO: 612, SEQ ID NO: 618, SEQ ID NO: 624, SEQ ID NO: 630, SEQ ID NO: 636, SEQ ID NO: 642, SEQ ID NO: 648, SEQ ID NO: 654, SEQ ID NO: 660, SEQ ID NO: 666, SEQ ID NO: 672, SEQ ID NO: 678, SEQ ID NO: 684, SEQ ID NO: 690, SEQ ID NO: 696, SEQ ID NO: 702, SEQ ID NO: 708, SEQ ID NO: 714, SEQ ID NO: 720, SEQ ID NO: 726, SEQ ID NO: 732, SEQ ID NO: 738, SEQ ID NO: 744, SEQ ID NO: 750, SEQ ID NO: 756, SEQ ID NO: 762, SEQ ID NO: 768, SEQ ID NO: 774, SEQ ID NO: 780, SEQ ID NO: 786, SEQ ID NO: 792, SEQ ID NO: 798, SEQ ID NO: 804, SEQ ID NO: 810, SEQ ID NO: 816, SEQ ID NO: 822, SEQ ID NO: 828, SEQ ID NO: 834, SEQ ID NO: 840, SEQ ID NO: 846, SEQ ID NO: 852, SEQ ID NO: 858, SEQ ID NO: 864, SEQ ID NO: 870, SEQ ID NO: 876, SEQ ID NO: 882, SEQ ID NO: 888, SEQ ID NO: 894, SEQ ID NO: 900, SEQ ID NO: 906, SEQ ID NO: 912, SEQ ID NO: 918, SEQ ID NO: 924, SEQ ID NO: 930, SEQ ID NO: 936, SEQ ID NO: 942, SEQ ID NO: 948, SEQ ID NO: 954, SEQ ID NO: 960, SEQ ID NO: 966, SEQ ID NO: 972, SEQ ID NO: 978, SEQ ID NO: 984, SEQ ID NO: 990, SEQ ID NO: 996, SEQ ID NO: 1002, SEQ ID NO: 1008, SEQ ID NO: 1014, SEQ ID NO: 1020, SEQ ID NO: 1026, SEQ ID NO: 1032, SEQ ID NO: 1038, SEQ ID NO: 1044, SEQ ID NO: 1050, SEQ ID NO: 1056, SEQ ID NO: 1062, SEQ ID NO: 1068, SEQ ID NO: 1074, SEQ ID NO: 1080, SEQ ID NO: 1086, SEQ ID NO: 1092, SEQ ID NO: 1098, SEQ ID NO: 1104, SEQ ID NO: 1110, SEQ ID NO: 1116, SEQ ID NO: 1122, SEQ ID NO: 1128, SEQ ID NO: 1134, SEQ ID NO: 1140, SEQ ID NO: 1146, SEQ ID NO: 1152, SEQ ID NO: 1158, SEQ ID NO: 1164, SEQ ID NO: 1170, SEQ ID NO: 1176, SEQ ID NO: 1182, SEQ ID NO: 1188, SEQ ID NO: 1194, SEQ ID NO: 1200, SEQ ID NO: 1206, SEQ ID NO: 1212, SEQ ID NO: 1218, SEQ ID NO: 1224, SEQ ID NO: 1230, SEQ ID NO: 1236, SEQ ID NO: 1242, SEQ ID NO: 1248, SEQ ID NO: 1254, SEQ ID NO: 1260, SEQ ID NO: 1266, SEQ ID NO: 1272, SEQ ID NO: 1278, SEQ ID NO: 1284, SEQ ID NO: 1290, SEQ ID NO: 1296, SEQ ID NO: 1302, SEQ ID NO: 1308, SEQ ID NO: 1314, SEQ ID NO: 1320, SEQ ID NO: 1326, SEQ ID NO: 1332, SEQ ID NO: 1338, SEQ ID NO: 1344, SEQ ID NO: 1350, SEQ ID NO: 1356, SEQ ID NO: 1362, SEQ ID NO: 1368, SEQ ID NO: 1374, SEQ ID NO: 1380, SEQ ID NO: 1386, SEQ ID NO: 1392, SEQ ID NO: 1398, SEQ ID NO: 1404, SEQ ID NO: 1410, SEQ ID NO: 1416, SEQ ID NO: 1422, SEQ ID NO: 1428, SEQ ID NO: 1434, SEQ ID NO: 1440, SEQ ID NO: 1446, SEQ ID NO: 1452, SEQ ID NO: 1458, SEQ ID NO: 1464, SEQ ID NO: 1470, SEQ ID NO: 1476, SEQ ID NO: 1482, SEQ ID NO: 1488, SEQ ID NO: 1494, SEQ ID NO: 1500, SEQ ID NO: 1506, SEQ ID NO: 1512, SEQ ID NO: 1518, SEQ ID NO: 1524, SEQ ID NO: 1598, SEQ ID NO: 1530, SEQ ID NO: 1536, SEQ ID NO: 1542, SEQ ID NO: 1548, SEQ ID NO: 1554, SEQ ID NO: 1560, SEQ ID NO: 1566, SEQ ID NO: 1572, SEQ ID NO: 1578, SEQ ID NO: 1584, or SEQ ID NO: 1590 in FIGS. 3A, 3B, 3C, 3D, 3E, 3F, 3G, 3H, 3I, 3J, 3K, or 3L, wherein the HCDR1, HCDR2, HCDR3, LCDR1, LCDR2, and LCDR3 are from a same clone.

In some embodiments, an isolated antibody comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 in FIG. 2A, 2B, or 2C, or a sequence at least 90% identical thereto.

In some embodiments, an isolated antibody comprises a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 in FIG. 2A, 2B, or 2C, or a sequence at least 90% identical thereto.

In some embodiments, an isolated antibody comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 in FIG. 2A, 2B, or 2C, or a sequence at least 90% identical thereto, and a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 in FIG. 2A, 2B, or 2C or a sequence at least 90% identical thereto.

In some embodiments, a composition comprises an isolated antigen binding molecule or antibody provided herein in an amount that is pharmaceutically acceptable, and a pharmaceutically acceptable carrier.

In some embodiments, a method of treating a TIGIT related disorder comprises identifying a subject with a TIGIT related disorder, and administering an effective dose of the isolated antigen binding molecule or antibody provided herein to the subject.

In some embodiments, a method of enhancing T-cell activation comprises diagnosing an individual with low T-cell counts, and administering an effective dose of the isolated antigen binding molecule or isolated antibody provided herein.

In some embodiments, a method of making an isolated antigen binding molecule that binds to human TIGIT comprises providing a nucleic acid that encodes for the isolated antigen binding molecule or isolated antibody provided herein, and expressing a protein encoded by the nucleic acid.

In some embodiments, a kit for determining the presence of human TIGIT comprises the isolated antigen binding molecule or isolated antibody provided herein, and a detectable marker.

In some embodiments, a method of preventing, treating and/or lessening the severity of an immune-related disease relating to aberrant immune cell response in a subject comprises modulating the activity of TIGIT in the subject by administering an effective amount of any one or more of the isolated antigen binding molecules or antibodies provided herein.

In some embodiments, disclosed herein is a method of increasing or stimulating an immune response by administering in vitro or in vivo an antagonist of TIGIT activity, and/or by inhibiting intracellular signaling mediated by TIGIT binding to PVR (aka CD155), wherein the antagonist of TIGIT activity is any one or more of the isolated antigen binding molecules or isolated antibodies provided herein.

In some embodiments, a method of increasing T cell activation comprises administering any one or more of the isolated antigen binding molecules or isolated antibodies provided herein to a subject in an amount sufficient to block TIGIT in the subject.

In some embodiments, a method of treating an infection or infectious disease in a human subject comprises administering to a subject who has an infectious disease an effective amount of the isolated antigen binding molecule or isolated antibody herein.

In some embodiments, a method for increasing an effectiveness of a vaccine comprises administering a vaccine to a subject, and administering any one or more of the isolated antigen binding molecules or antibodies provided herein to the subject in an amount sufficient to serve as an adjuvant for the vaccine.

In some embodiments, a method for treating an infection comprises identifying a subject that has a viral infection, a bacterial infection, parasitic infection, and/or a fungal infection, and administering any one or more of the antigen binding molecules or isolated antibodies provided herein to the subject in an amount and for a duration sufficient to treat the viral infection, the bacterial infection, the parasitic infection, and/or the fungal infection.

In some embodiments, a method for preventing and/or inhibiting TIGIT binding to MHC class II to enhance antigen-specific T-cell activation or stimulating T-cell production of interleukin-2 in a subject comprises administering any one or more of the antigen binding molecules provided herein to a subject in an amount sufficient for preventing and/or inhibiting TIGIT binding to MHC class II in the subject.

In some embodiments, a method of preventing, treating and/or lessening the severity of a disease in a subject comprises modulating the activity of TIGIT in the subject by administering an effective amount of any one or more of the isolated antigen binding molecules or isolated antibody provided herein, wherein the disease is selected from the group consisting of: systemic lupus erythematosis, rheumatoid arthritis, juvenile chronic arthritis, spondyloarthropathies, systemic sclerosis (scleroderma), idiopathic inflammatory myopathies (dermatomyositis, polymyositis), Sjogren's syndrome, systemic vasculitis, sarcoidosis, autoimmune hemolytic anemia (immune pancytopenia, paroxysmal nocturnal hemoglobinuria), autoimmune thrombocytopenia (idiopathic thrombocytopenic purpura, immune-mediated thrombocytopenia), thyroiditis (Grave's disease, Hashimoto's thyroiditis, juvenile lymphocytic thyroiditis, atrophic thyroiditis), diabetes mellitus, immune-mediated renal disease (glomerulonephritis, tubulointerstitial nephritis), demyelinating diseases of the central and peripheral nervous systems such as multiple sclerosis, idiopathic demyelinating polyneuropathy or Guillain-Barre syndrome, and chronic inflammatory demyelinating polyneuropathy, hepatobiliary diseases such as infectious hepatitis (hepatitis A, B, C, D, E and other non-hepatotropic viruses), autoimmune chronic active hepatitis, primary biliary cirrhosis, granulomatous hepatitis, and sclerosing cholangitis, inflammatory bowel disorder (IBD) (ulcerative colitis: Crohn's disease), gluten-sensitive enteropathy, and Whipple's disease, autoimmune or immune-mediated skin diseases including bullous skin diseases, erythema multiforme and contact dermatitis, psoriasis, allergic diseases such as asthma, allergic rhinitis, atopic dermatitis, food hypersensitivity and urticaria, immunologic diseases of the lung such as eosinophilic pneumonias, idiopathic pulmonary fibrosis and hypersensitivity pneumonitis, transplantation associated diseases including graft rejection and graft-versus-host-disease. Infectious diseases including viral diseases such as AIDS (HIV infection), hepatitis A, B, C, D, and E, herpes, etc., bacterial infections, fungal infections, protozoal infections and parasitic infections also may have immune and/or inflammatory components and/or etiology.

In some embodiments, an isolated antigen binding molecule that binds to human TIGIT comprises at least one of: (a) (i) a heavy chain variable region comprising the heavy chain of clone Ab117 (SEQ ID NO: 62) and (ii) a light chain variable region comprising the light chain of clone Ab117 (SEQ ID NO: 159); (b) (i) a heavy chain variable region comprising the heavy chain of clone Ab53 (SEQ ID NO: 199) and (ii) a light chain variable region comprising the light chain of clone Ab53 (SEQ ID NO: 214); (c) (i) a heavy chain variable region comprising the heavy chain of clone Ab40 (SEQ ID NO: 200) and (ii) a light chain variable region comprising the light chain of clone Ab40 (SEQ ID NO: 215); (d) (i) a heavy chain variable region comprising the heavy chain of clone Ab48 (SEQ ID NO: 203) and (ii) a light chain variable region comprising the light chain of clone Ab48 (SEQ ID NO: 218); (e) (i) a heavy chain variable region comprising the heavy chain of clone Ab1 (SEQ ID NO: 299) and (ii) a light chain variable region comprising the light chain of clone Ab1 (SEQ ID NO: 385); or (f) (i) a heavy chain variable region comprising the heavy chain of clone Ab143 (SEQ ID NO: 279) and (ii) a light chain variable region comprising the light chain of clone Ab143 (SEQ ID NO: 365).

BRIEF DESCRIPTION OF THE DRAWINGS

FIG. 1 depicts an alignment of various TIGIT sequences.
FIGS. 2A-2R depict embodiments of various anti-TIGIT antigen binding molecule sequences.
FIGS. 3A-3L depict embodiments of various anti-TIGIT antigen binding molecule sequences.
FIG. 4 depicts embodiments of various TIGIT sequences.
FIG. 5 shows embodiments of sequences of heavy chain CDRs of antigen binding molecules.

DETAILED DESCRIPTION

Figure 1:
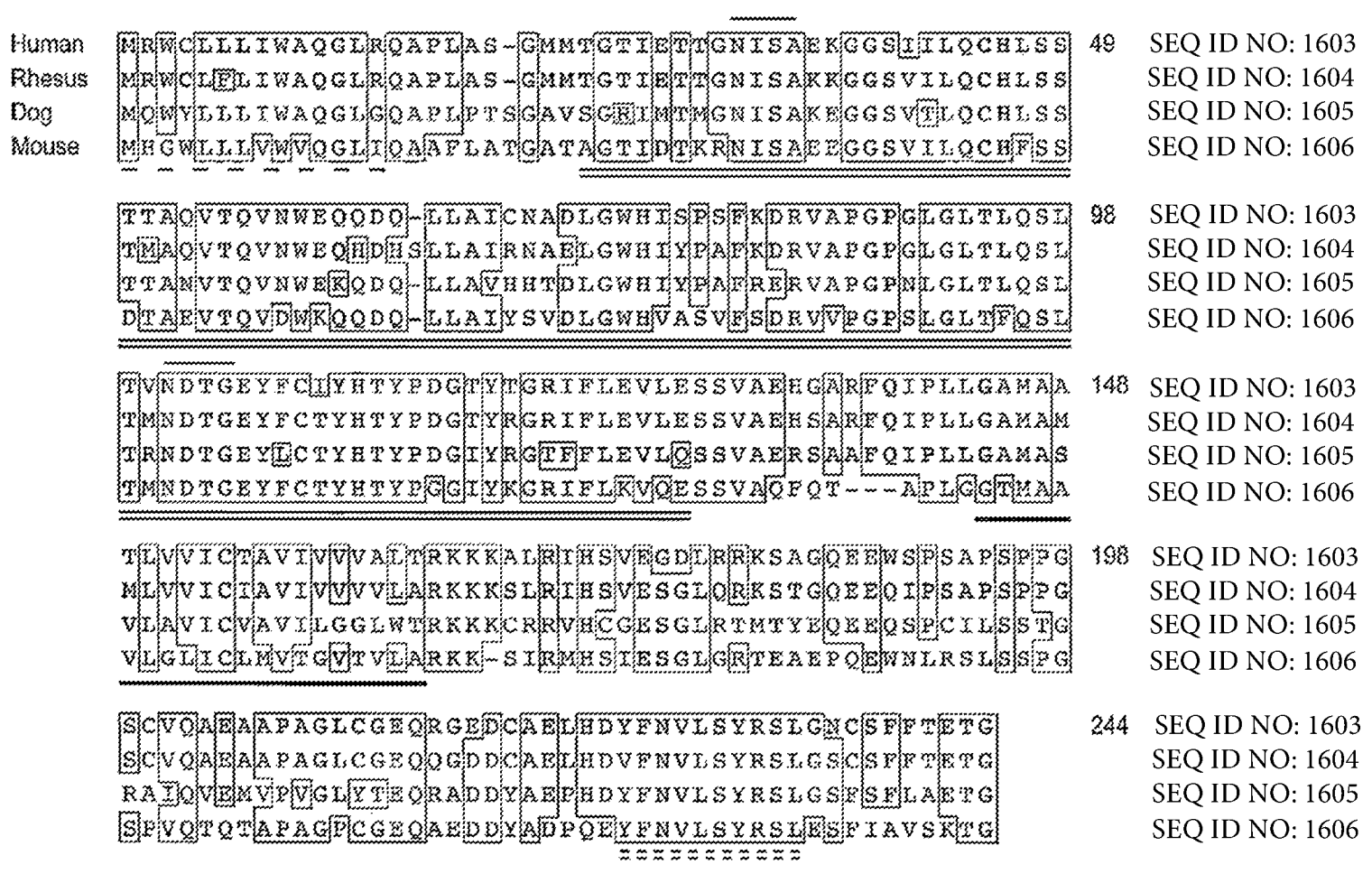

Provided herein are antigen binding molecules that bind to the TIGIT protein, preferably, the human TIGIT human protein. FIG. 1 depicts a sequence alignment of various forms of TIGIT, including the human TIGIT. Some embodiments of the antigen binding molecules are applicable for diagnostic purposes. In some embodiments, the antigen binding molecules are antibodies or antigen binding fragments thereof. In some embodiments, the antigen binding molecules are agonists, and thereby activate or increase TIGIT mediated signaling. In some embodiments, the antigen binding molecules are antagonists, and thereby inhibit or decrease TIGIT mediated signaling. The following description provides an initial outline of abbreviations and definitions, followed by a set of preferred embodiments and examples.

Abbreviations

Throughout the detailed description and examples the following abbreviations will be used:

| | |
|---|---|
| ADCC: | Antibody-dependent cellular cytotoxicity |
| CDC: | Complement-dependent cytotoxicity |
| CDR: | Complementarity determining region in the immunoglobulin variable regions |
| CHO: | Chinese hamster ovary |
| FR: | Antibody framework region: the immunoglobulin variable regions excluding the CDR regions. |
| IC50: | concentration resulting in 50% inhibition |
| IgG: | Immunoglobulin G |
| mAb or Mab or MAb: | Monoclonal antibody |
| V region: | The segment of IgG chains which is variable in sequence between different antibodies. It extends to Kabat residue 109 in the light chain and 113 in the heavy chain. |
| VH: | Immunoglobulin heavy chain variable region |
| VK: | Immunoglobulin kappa light chain variable region |

Definitions

So that the various embodiments may be more readily understood, certain technical and scientific terms are specifically defined below. Unless specifically defined elsewhere in this document, all other technical and scientific terms used herein have the meaning commonly understood by one of ordinary skill in the art to which this invention belongs.

As used herein, including the appended claims, the singular forms of words such as "a," "an," and "the," include their corresponding plural references unless the context clearly dictates otherwise.

"Administration" as it applies to an animal, human, experimental subject, cell, tissue, organ, or biological fluid, refers to contact of an exogenous pharmaceutical, therapeutic, diagnostic agent, or composition to the animal, human, subject, cell, tissue, organ, or biological fluid. "Administration" also means in vitro and ex vivo treatments, e.g., of a cell, by a reagent, diagnostic, binding compound, or by another cell. Administration can be of the antibody directly to the subject. Administration can be via a vector or other approach as well (administering nucleic acid that encodes the antibody).

"Treat", "treating", or "treatment" means to administer a therapeutic agent, such as a composition containing any of the antibodies or antigen-binding fragments provided herein, internally or externally to a subject or patient having one or more disease symptoms, or being suspected of having a disease, for which the agent has therapeutic activity. Typically, the agent is administered in an amount effective to alleviate one or more disease symptoms in the treated subject or population, whether by inducing the regression of or inhibiting the progression of such symptom(s) by any clinically measurable degree. The amount of a therapeutic agent that is effective to alleviate any particular disease symptom may vary according to factors such as the disease state, age, and weight of the patient, and the ability of the drug to elicit a desired response in the subject. Whether a disease symptom has been alleviated can be assessed by any clinical measurement typically used by physicians or other skilled healthcare providers to assess the severity or progression status of that symptom. "Treatment" refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented.

"Mammal" for purposes of treatment refers to any animal classified as a mammal, including humans, domestic and farm animals, and zoo, sports, or pet animals, such as dogs, cats, cattle, horses, sheep, pigs, goats, rabbits, etc. Preferably, the mammal is human.

Administration "in combination with" one or more further therapeutic agents includes simultaneous (concurrent) and consecutive administration in any order.

"Carriers" as used herein include pharmaceutically acceptable carriers, excipients, or stabilizers which are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™.

The term TIGIT includes human TIGIT, cynomolgous monkey TIGIT and rhesus TIGIT as well as fragments thereof such as the mature fragment thereof lacking the signal peptide. In some embodiments, the amino acid sequence of human TIGIT comprises the amino acid sequence disclosed in amino acid residues 25-244 of Genbank Accession Number NP 776160.2 (amino acid residues 1-24 correspond to a leader peptide.) In some embodiments, the amino acid sequence of cynomolgous monkey, e.g., *Macaca fascicularis* TIGIT comprises the amino acid sequence in Genbank Accession no. XP 005548157. The amino acid sequence of rhesus monkey TIGIT is identical to the amino acid sequence of cynomolgous monkey TIGIT. (Amino acid residues 1-24 correspond to a leader peptide.) Examples of TIGIT sequences are shown in FIG. 1 and FIG. 4. Unless specified otherwise, the term human TIGIT will denote the first sequence in FIG. 4 (with or without a leader peptide).

As used herein, the term "antigen binding molecule" includes both antibodies and antigen binding fragments thereof. An antigen binding molecule that binds to TIGIT refers to an antibody or antigen-binding fragment thereof that "specifically" binds to TIGIT. An antigen binding molecule that "specifically" binds to human TIGIT is an antigen binding molecule that binds to human TIGIT with a $K_D$ of about 1 microM or a higher affinity (e.g., 1 micromolar, 0.1 micromolar, 0.01 micromolar, 1 nM-2 pM, 1 nM, 100 pM, 10 pM or 2 pM), but does not bind to other proteins lacking this (or a part thereof) sequence. For example, an antigen binding molecule that "specifically binds" human TIGIT does not bind to human CD226 and human CD155. In some embodiments, the antigen binding molecule that specifically binds to TIGIT can bind to a fragment of a TIGIT protein, as long as it also binds to the native form of TIGIT. Where desired, a full length antibody can be designated as an "intact" antibody (as opposed to an antigen binding fragment of the intact antibody).

As used herein "cross-reactivity" refers to the ability of an antigen binding molecule to react with a homologous protein from other species. Whether an antigen binding molecule specifically binds to human TIGIT can be determined using any assay known in the art. Examples of assays known in the art to determining binding affinity include surface plasmon resonance (e.g., BIACORE) or a similar technique (e.g. KinExa or OCTET).

The term "antibody" is used in the broadest sense and specifically covers, for example, single anti-TIGIT monoclonal antibodies or antibodies that specifically bind to any of the other polypeptides described herein (including agonist, antagonist, and neutralizing antibodies), anti-TIGIT or antibody compositions with polyepitopic specificity, single chain anti-TIGIT or other antibodies. The term "monoclonal antibody" as used herein refers to an antibody that is part of a substantially homogeneous collection of antibodies, i.e., the individual antibodies comprising the population are identical except for possible naturally-occurring mutations that may be present in minor amounts.

Some embodiments provided herein include non-human parental (e.g. mouse and rodent) anti-TIGIT antibodies and antigen-binding fragments thereof and methods of use thereof. These antibodies may be modified for an intended use, such as humanization of an antibody for use as a human therapeutic antibody or fragment.

Some embodiments provided herein include anti-TIGIT antigen-binding fragments and methods of use thereof. Examples of antigen-binding fragments include, but are not limited to, Fab, Fab', F(ab')$_2$, and Fv fragments; diabodies; linear antibodies; single-chain antibody molecules, e.g., sc-Fv; nanobodies and multispecific antibodies formed from antibody fragments.

Some embodiments provided herein include anti-TIGIT Fab fragments and methods of use thereof. A "Fab fragment" is comprised of one light chain and the $C_H1$ and variable regions of one heavy chain. The heavy chain of a Fab molecule cannot form a disulfide bond with another heavy chain molecule. An "Fab fragment" can be the product of papain cleavage of an antibody.

Some embodiments provided herein include anti-TIGIT antibodies and antigen-binding fragments thereof which comprise an Fc region and methods of use thereof. An "Fc" region contains two heavy chain fragments comprising the $C_H1$ and $C_H2$ domains of an antibody. The two heavy chain fragments are held together by two or more disulfide bonds and by hydrophobic interactions of the $C_H3$ domains.

Some embodiments provided herein include anti-TIGIT Fab' fragments and methods of use thereof. A "Fab' fragment" contains one light chain and a portion or fragment of one heavy chain that contains the VHdomain and the $C_H1$ domain and also the region between the $C_H1$ and $C_H2$ domains, such that an interchain disulfide bond can be formed between the two heavy chains of two Fab' fragments to form a F(ab')2 molecule. Also contemplated are anti-TIGIT F(ab')2 fragments and methods of use thereof. A "F(ab')2 fragment" contains two light chains and two heavy chains containing a portion of the constant region between the $C_H1$ and $C_H2$ domains, such that an interchain disulfide bond is formed between the two heavy chains. A F(ab')2 fragment thus is composed of two Fab' fragments that are held together by a disulfide bond between the two heavy chains. An "F(ab')2 fragment" can be the product of pepsin cleavage of an antibody.

Some embodiments provided herein include anti-TIGIT Fv fragments and methods of use thereof. The "Fv region" comprises the variable regions from both the heavy and light chains, but lacks the constant regions.

Some embodiments provided herein include anti-TIGIT scFv fragments and methods of use thereof. The term "single-chain Fv" or "scFv" antibody refers to antibody fragments comprising the VH and VL domains of an antibody, wherein these domains are present in a single polypeptide chain. Generally, the Fv polypeptide further comprises a polypeptide linker between the VH and VL domains which enables the scFv to form the desired structure for antigen-binding. For a review of scFv, see Pluckthun (1994) THE PHARMACOLOGY OF MONOCLONAL ANTIBODIES, vol. 113, Rosenburg and Moore eds. Springer-Verlag, New York, pp. 269-315. See also, International Patent Application Publication No. WO 88/01649 and U.S. Pat. Nos. 4,946,778 and 5,260,203.

Some embodiments provided herein include a domain antibody. A "domain antibody" is an immunologically functional immunoglobulin fragment containing only the variable region of a heavy chain or the variable region of a light chain. In some instances, two or more $V_H$ regions are covalently joined with a peptide linker to create a bivalent domain antibody. The two $V_H$ regions of a bivalent domain antibody may target the same or different antigens. In some embodiments, surrobody arrangements can also be used with one or more of the CDRs and/or variable chain regions provided herein. Surrobodies include an antibody heavy chain paired with two surrogate light chain components. See, e.g., Xu et al "Combinatorial surrobody libraties" PNAS; 105, 10756-10761, Jul. 29, 2008, and WO2013109994, US20150011736. In somem embodiments, the surrogate light chain can include a VpreB section and a lambda5 section.

Some embodiments provided herein include a bivalent antibody. A "bivalent antibody" comprises two antigen-binding sites. In some embodiments, the two binding sites have the same antigen specificities. However, bivalent antibodies may be bispecific. Some embodiments provided herein include bispecific antibodies.

Some embodiments provided herein include anti-TIGIT camelized single domain antibodies and methods of use thereof. In certain embodiments, antibodies herein also include camelized single domain antibodies. See, e.g., Muyldermans et al. (2001) Trends Biochem. Sci. 26:230; Reichmann et al. (1999) J. Immunol. Methods 231:25; WO 94/04678; WO 94/25591; U.S. Pat. No. 6,005,079). In some embodiments, single domain antibodies comprising two VH domains with modifications such that single domain antibodies are formed are provided.

Some embodiments provided herein include anti-TIGIT diabodies and methods of use thereof. As used herein, the term "diabodies" refers to small antibody fragments with two antigen-binding sites, which fragments comprise a heavy chain variable domain ($V_H$) connected to a light chain variable domain ($V_L$) in the same polypeptide chain ($V_H$-$V_L$ or $V_L$-$V_H$). By using a linker that is too short to allow pairing between the two domains on the same chain, the domains are forced to pair with the complementary domains of another chain and create two antigen-binding sites. Diabodies are described more fully in, e.g., EP 404,097; WO 93/11161; and Holliger et al. (1993) Proc. Natl. Acad. Sci. USA 90: 6444-6448. For a review of engineered antibody variants generally see Holliger and Hudson (2005) Nat. Biotechnol. 23: 1126-1136.

Typically, an antigen binding molecule that is modified in some way retains at least 10% of its binding activity (when compared to the parental antibody) when that activity is expressed on a molar basis. Preferably, an antigen binding molecule retains at least 20%, 50%, 70%, 80%, 90%, 95% or 100% or more of the TIGIT binding affinity as the parental antibody. It is also intended that an antigen binding molecule can include conservative or non-conservative amino acid substitutions (referred to as "conservative variants" or "function conserved variants" of the antigen binding molecule) that do not substantially alter its biologic activity.

Some embodiments provided herein include isolated anti-TIGIT antigen binding molecules and methods of use thereof. "Isolated" antigen binding molecules (e.g., antibodies or antigen-binding fragments thereof) are at least partially free of other biological molecules from the cells or cell cultures in which they are produced. Such biological molecules include nucleic acids, proteins, lipids, carbohydrates, or other material such as cellular debris and growth medium. An isolated antigen binding molecule (e.g., antibody or antigen-binding fragment) may further be at least partially free of expression system components such as biological molecules from a host cell or of the growth medium thereof. Generally, the term "isolated" is not intended to refer to a complete absence of such biological molecules or to an absence of water, buffers, or salts or to components of a pharmaceutical formulation that includes the antibodies or fragments. In some embodiments, the antigen binding molecule will be purified (1) to greater than 95% by weight of antibody, and most preferably more than 99% by weight or (2) to homogeneity by SDS-PAGE under reducing or nonreducing conditions using a dye or stain such as, but not limited to, Coomassie blue or silver stain. Isolated antibody includes the antibody in situ within recombinant cells since at least one component of the antibody's natural environment will not be present.

Some embodiments provided herein include anti-TIGIT chimeric antibodies (e.g., human constant domain/mouse variable domain) and methods of use thereof. As used herein, a "chimeric antibody" is an antibody having the variable domain from a first antibody and the constant domain from a second antibody, where the first and second antibodies are from different species. (U.S. Pat. No. 4,816,567; and Morrison et al, (1984) Proc. Natl. Acad. Sci. USA 81: 6851-6855). Typically, the variable domains are obtained from an antibody from an experimental animal (the "parental antibody"), such as a rodent, and the constant domain sequences are obtained from human antibodies, so that the resulting chimeric antibody will be less likely to elicit an adverse immune response in a human subject than the parental (e.g., mouse) antibody. Some embodiments provided herein include anti-TIGIT human antibodies.

Some embodiments provided herein include anti-TIGIT humanized antibodies and antigen-binding fragments thereof (e.g., rat or mouse antibodies that have been humanized) and methods of use thereof. As used herein, the term "humanized antibody" refers to forms of antibodies that contain sequences from both human and non-human (e.g. mouse or rat) antibodies. In general, the humanized antibody will comprise substantially all of at least one, and typically two, variable domains, in which all or substantially all of the hypervariable loops correspond to those of a non-human immunoglobulin, and all or substantially all of the framework (FR) regions are those of a human immunoglobulin sequence. The humanized antibody may optionally comprise at least a portion of a human immunoglobulin constant region (Fc). These options also apply to antigen binding molecules.

In general, the basic antibody structural unit comprises a tetramer. Each tetramer includes two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of the heavy chain may define a constant region primarily responsible for effector function. Typically, human light chains are classified as kappa and lambda light chains. Furthermore, human heavy chains are typically classified as mu, delta, gamma, alpha, or epsilon, and define the antibody's isotype as IgM, IgD, IgG, IgA, and IgE, respectively. Within light and heavy chains, the variable and constant regions are joined by a "J" region of about 12 or more amino acids, with the heavy chain also including a "D" region of about 10 more amino acids. See generally, Fundamental Immunology Ch. 7 (Paul, W., ed., 2nd ed. Raven Press, N.Y. (1989).

The variable regions of each light/heavy chain pair form the antibody binding site. Thus, in general, an intact antibody has two binding sites. Except in bifunctional or bispecific antibodies, the two binding sites are, in general, the same.

Typically, the variable domains of both the heavy and light chains comprise three hypervariable regions, also called complementarity determining regions (CDRs), located within relatively conserved framework regions (FR). The CDRs are usually aligned by the framework regions, enabling binding to a specific epitope. In general, from N-terminal to C-terminal, both light and heavy chains variable domains comprise FR1, CDR1, FR2, CDR2, FR3, CDR3 and FR4. The assignment of amino acids to each domain is, generally, in accordance with the definitions of Sequences of Proteins of Immunological Interest, Kabat, et al.; National Institutes of Health, Bethesda, Md.; 5th ed.; NIH Publ. No. 91-3242 (1991); Kabat (1978) Adv. Prot. Chem. 32:1-75; Kabat, et al, (1977) J. Biol. Chem. 252: 6609-6616; Chothia, et al, (1987) J Mol. Biol. 196:901-917 or Chothia, et al., (1989) Nature 342:878-883.

CDRs (e.g., CDRL1, CDRL2 and CDRL3 in the light chain variable domain and CDRH1, CDRH2 and CDRH3 in the heavy chain variable domain) can also be identified following Chothia and Lesk (1987) J. Mol. Biol. 196: 901-917 (defining the CDR regions of an antibody by structure). As used herein, the term "framework" or "FR" residues refers to those variable domain residues other than the hypervariable region residues defined herein as CDR residues. Additional CDR delineations are in use and are encompassed herein. The Chothia approach refers to the location of the structural loops (Chothia and Lesk J. Mol. Biol. 196:901-917 (1987)). The AbM CDRs represent a compromise between the Kabat CDRs and Chothia structural loops, and are used by Oxford Molecular's AbM antibody modeling software. The "contact" CDRs are based on an analysis of the available complex crystal structures. The residues from each of these CDRs are noted below.

TABLE 0.1

| Loop | Kabat | AbM | Chothia | Contact |
|------|-------|-----|---------|---------|
| L1 | L24-L34 | L24-L34 | L26-L32 | L30-L36 |
| L2 | L50-L56 | L50-L56 | L50-L52 | L46-L55 |

TABLE 0.1-continued

| Loop | Kabat | AbM | Chothia | Contact |
|---|---|---|---|---|
| L3 | L89-L97 | L89-L97 | L91-L96 | L89-L96 |
| H1 | H31-H35B | H26-H35B | H26-H32 | H30-H35B |
|  |  | (Kabat Numbering) |  |  |
| H1 | H31-H35 | H26-H35 | H26-H32 | H30-H35 |
|  |  | (Chothia Numbering) |  |  |
| H2 | H50-H65 | H50-H58 | H53-H55 | H47-H58 |
| H3 | H95-H102 | H95-H102 | H96-H101 | H93-H101 |

CDRs may comprise "extended CDRs" as follows: 24-36 or 24-34 (L1), 46-56 or 50-56 (L2) and 89-97 or 89-96 (L3) in the VL and 26-35 (H1), 50-65 or 49-65 (H2) and 93-102, 94-102, or 95-102 (H3) in the VH. The variable domain residues are numbered according to Kabat et al., supra, for each of these definitions. As provided herein, any one or more of the above CDR definitions may be used to identify the CDRs of the anti-TIGIT antibody, within any given heavy and/or light chain sequence. Thus, for any antibody chain sequence provided herein, all forms of the CDR collection (all three within the chain) are contemplated. In some embodiments, the CDR sequences are those provided in FIGS. 3A-3L.

Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2. In some embodiments, the anti-TIGIT antibody can be any one of these isotypes.

"Isolated nucleic acid molecule" or "isolated polynucleotide" means a DNA or RNA of genomic, mRNA, cDNA, or synthetic origin or some combination thereof which is not associated with all or a portion of a polynucleotide in which the isolated polynucleotide is found in nature, or is linked to a polynucleotide to which it is not linked in nature. For purposes of this disclosure, it should be understood that "a nucleic acid molecule comprising" a particular nucleotide sequence does not encompass intact chromosomes. Isolated nucleic acid molecules "comprising" specified nucleic acid sequences may include, in addition to the specified sequences, coding sequences for up to ten or even up to twenty or more other proteins or portions or fragments thereof, or may include operably linked regulatory sequences that control expression of the coding region of the recited nucleic acid sequences, and/or may include vector sequences.

The phrase "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to use promoters, polyadenylation signals, and enhancers.

A nucleic acid or polynucleotide is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, but not always, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

As used herein, the expressions "cell," "cell line," and "cell culture" are used interchangeably and all such designations include progeny. Thus, the words "transformants" and "transformed cells" include the primary subject cell and cultures derived therefrom without regard for the number of transfers. It is also understood that not all progeny will have precisely identical DNA content, due to deliberate or inadvertent mutations. Mutant progeny that have the same function or biological activity as screened for in the originally transformed cell are included. Where distinct designations are intended, it will be clear from the context.

As used herein, "germline sequence" refers to a sequence of unrearranged immunoglobulin DNA sequences. Any suitable source of unrearranged immunoglobulin sequences may be used. Human germline sequences may be obtained, for example, from JOINSOLVER germline databases on the website for the National Institute of Arthritis and Musculoskeletal and Skin Diseases of the United States National Institutes of Health. Mouse germline sequences may be obtained, for example, as described in Giudicelli et al. (2005) Nucleic Acids Res. 33:D256-D261.

"Stringent conditions" or "high stringency conditions", as defined herein, may be identified by those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 microgram/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C.

"Moderately stringent conditions" may be identified as described by Sambrook et al., Molecular Cloning: A Laboratory Manual, New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

The terms "TIGIT antagonist" and "antagonist of TIGIT activity" are used interchangeably and refer to a compound that interferes with the normal functioning of TIGIT, by inhibiting or blocking TIGIT polypeptide activity. Examples of TIGIT antagonists include, but are not limited to antigen binding molecules that bind TIGIT, anti-TIGIT antibodies, and TIGIT-binding fragments of anti-TIGIT antibodies that specifically bind TIGIT such that the interaction between the TIGIT antagonist and TIGIT results in a reduction or cessation of TIGIT activity. It will be understood by one of ordinary skill in the art that in some instances, a TIGIT antagonist may antagonize one TIGIT activity without affecting another TIGIT activity. For example, in some embodiments, a TIGIT antagonist for use in certain of the methods herein is a TIGIT antagonist that antagonizes TIGIT activity in response to one of PVR interaction, PVRL3 interaction, or PVRL2 interaction, e.g., without affecting or minimally affecting any of the other TIGIT interactions. PVR is also known as CD155 and PVRL2 is also known as PVRL2.

The terms "TIGIT agonist" and "agonist of TIGIT activity" are used interchangeably and refer to a compound that enhances or stimulates the normal functioning of TIGIT by enhancing normal TIGIT activity (including, but not limited to, enhancing the stability of TIGIT or enhancing binding of TIGIT to one or more target ligands). For example, the TIGIT agonist can be selected from an antigen binding molecule, antibody, and an antigen-binding fragment thereof. It will be understood by one of ordinary skill in the art that in some instances, a TIGIT agonist may agonize one TIGIT activity without affecting another TIGIT activity. For example, a desirable TIGIT agonist for use in certain of the methods herein is a TIGIT agonist that agonizes TIGIT activity in response to, or in place of, one of PVR interaction, PVRL3 interaction, or PVRL2 interaction, e.g., without affecting or minimally affecting any of the other TIGIT interactions.

The term "immune-related disease" means a disease in which a component of the immune system of a mammal causes, mediates or otherwise contributes to a morbidity in the mammal. Also included are diseases in which stimulation or intervention of the immune response has an ameliorative effect on progression of the disease. Included within this term are immune-mediated inflammatory diseases, non-immune-mediated inflammatory diseases, infectious diseases, immunodeficiency diseases, neoplasia, etc.

The term "T cell mediated disease" means an immune-related disease in which T cells directly or indirectly mediate or otherwise contribute to a morbidity in a mammal. The T cell mediated disease may be associated with cell mediated effects, lymphokine mediated effects, etc., and even effects associated with B cells if the B cells are stimulated, for example, by the lymphokines secreted by T cells.

Examples of immune-related and inflammatory diseases, some of which are immune or T cell mediated, which can be treated include systemic lupus erythematosis, rheumatoid arthritis, juvenile chronic arthritis, spondyloarthropathies, systemic sclerosis (scleroderma), idiopathic inflammatory myopathies (dermatomyositis, polymyositis), Sjogren's syndrome, systemic vasculitis, sarcoidosis, autoimmune hemolytic anemia (immune pancytopenia, paroxysmal nocturnal hemoglobinuria), autoimmune thrombocytopenia (idiopathic thrombocytopenic purpura, immune-mediated thrombocytopenia), thyroiditis (Grave's disease, Hashimoto's thyroiditis, juvenile lymphocytic thyroiditis, atrophic thyroiditis), diabetes mellitus, immune-mediated renal disease (glomerulonephritis, tubulointerstitial nephritis), demyelinating diseases of the central and peripheral nervous systems such as multiple sclerosis, idiopathic demyelinating polyneuropathy or Guillain-Barre syndrome, and chronic inflammatory demyelinating polyneuropathy, hepatobiliary diseases such as infectious hepatitis (hepatitis A, B, C, D, E and other non-hepatotropic viruses), autoimmune chronic active hepatitis, primary biliary cirrhosis, granulomatous hepatitis, and sclerosing cholangitis, inflammatory bowel disorder (IBD) (ulcerative colitis: Crohn's disease), gluten-sensitive enteropathy, and Whipple's disease, autoimmune or immune-mediated skin diseases including bullous skin diseases, erythema multiforme and contact dermatitis, psoriasis, allergic diseases such as asthma, allergic rhinitis, atopic dermatitis, food hypersensitivity and urticaria, immunologic diseases of the lung such as eosinophilic pneumonias, idiopathic pulmonary fibrosis and hypersensitivity pneumonitis, transplantation associated diseases including graft rejection and graft-versus-host-disease. Infectious diseases including viral diseases such as AIDS (HIV infection), hepatitis A, B, C, D, and E, herpes, etc., bacterial infections, fungal infections, protozoal infections and parasitic infections also may have immune and/or inflammatory components and/or etiology.

Several diseases of the skin are correlated with an aberrant immune response and to autoimmunity. Diseases such as psoriasis are hallmarked by skin blistering, skin flaking, edema and the presence of autoantibodies that bind to skin proteins. TIGIT expression is upregulated in psoriatic skin vs. normal skin. Modulation of TIGIT expression and/or activity may be useful in treating the symptoms or underlying causes of psoriasis.

The term inflammatory bowel disorder ("IBD") describes a group of chronic inflammatory disorders of unknown causes in which the intestine (bowel) becomes inflamed, often causing recurring cramps or diarrhea. The prevalence of IBD in the US is estimated to be about 200 per 100,000 population. Patients with IBD can be divided into two major groups, those with ulcerative colitis ("UC") and those with Crohn's disease ("CD").

In patients with UC, there is an inflammatory reaction primarily involving the colonic mucosa. The inflammation is typically uniform and continuous with no intervening areas of normal mucosa. Surface mucosal cells as well as crypt epithelium and submucosa are involved in an inflammatory reaction with neutrophil infiltration. Ultimately, this situation typically progresses to epithelial damage with loss of epithelial cells resulting in multiple ulcerations, fibrosis, dysplasia and longitudinal retraction of the colon. CD differs from UC in that the inflammation extends through all layers of the intestinal wall and involves mesentery as well as lymph nodes. CD may affect any part of the alimentary canal from mouth to anus. The disease is often discontinuous, i.e., severely diseased segments of bowel are separated from apparently disease-free areas. In CD, the bowel wall also thickens which can lead to obstructions. In addition, fistulas and fissures are not uncommon.

Clinically, IBD is characterized by diverse manifestations often resulting in a chronic, unpredictable course. Bloody diarrhea and abdominal pain are often accompanied by fever and weight loss. Anemia is not uncommon, as is severe fatigue. Joint manifestations ranging from arthralgia to acute arthritis as well as abnormalities in liver function are commonly associated with IBD. Patients with IBD also have an increased risk of colon carcinomas compared to the general population. During acute "attacks" of IBD, work and other normal activity are usually impossible, and often a patient is hospitalized.

Although the cause of IBD remains unknown, several factors, such as genetic, infectious and immunologic susceptibility, have been implicated. IBD is much more common in Caucasians, especially those of Jewish descent. The chronic inflammatory nature of the condition has prompted an intense search for a possible infectious cause. Although agents have been found which stimulate acute inflammation, none has been found to cause the chronic inflammation associated with IBD. The hypothesis that IBD is an autoimmune disease is supported by the previously mentioned extraintestinal manifestation of IBD as joint arthritis, and the known positive response to IBD by treatment with therapeutic agents such as adrenal glucocorticoids, cyclosporine and azathioprine, which are known to suppress immune response. In addition, the GI tract, more than any other organ of the body, is continuously exposed to potential antigenic substances such as proteins from food, bacterial byproducts (LPS), etc.

Further, the risk of colon cancer is highly elevated in patients with severe ulcerative colitis, particularly if the disease has existed for several years. About 20-25% of patients with IBD eventually require surgery for removal of the colon because of massive bleeding, chronic debilitating illness, performation of the colon, or risk of cancer. Surgery is also sometimes performed when other forms of medical treatment fail or when the side effects of steroids or other medications threaten the patient's health. As surgery is invasive and drastically life altering, it is not a highly desirable treatment regimen, and is typically the treatment of last resort. In order to better understand this disease and possibly treat it, experiments determined that TIGIT was upregulated both in CD and UC when compared to normal tissue. Modulation of the expression and/or activity of TIGIT may prove useful in the treatment of one or more forms of IBD.

Rheumatoid arthritis (RA) is a chronic systemic autoimmune inflammatory disease that mainly involves the synovial membrane of multiple joints with resultant injury to the articular cartilage. The pathogenesis is T lymphocyte dependent and is associated with the production of rheumatoid factors, auto-antibodies directed against self IgG, with the resultant formation of immune complexes that attain high levels in joint fluid and blood. These complexes in the joint may induce the marked infiltrate of lymphocytes and monocytes into the synovium and subsequent marked synovial changes; the joint space/fluid if infiltrated by similar cells with the addition of numerous neutrophils. Tissues affected are primarily the joints, often in symmetrical pattern. However, extra-articular disease also occurs in two major forms. One form is the development of extra-articular lesions with ongoing progressive joint disease and typical lesions of pulmonary fibrosis, vasculitis, and cutaneous ulcers. The second form of extra-articular disease is the so called Felty's syndrome which occurs late in the RA disease course, sometimes after joint disease has become quiescent, and involves the presence of neutropenia, thrombocytopenia and splenomegaly. This can be accompanied by vasculitis in multiple organs with formations of infarcts, skin ulcers and gangrene. Patients often also develop rheumatoid nodules in the subcutis tissue overlying affected joints; the nodules late stage have necrotic centers surrounded by a mixed inflammatory cell infiltrate. Other manifestations which can occur in RA include: pericarditis, pleuritis, coronary arteritis, intestitial pneumonitis with pulmonary fibrosis, keratoconjunctivitis sicca, and rhematoid nodules.

Juvenile chronic arthritis is a chronic idiopathic inflammatory disease which begins often at less than 16 years of age. Its phenotype has some similarities to RA; some patients which are rhematoid factor positive are classified as juvenile rheumatoid arthritis. The disease is sub-classified into three major categories: pauciarticular, polyarticular, and systemic. The arthritis can be severe and is typically destructive and leads to joint ankylosis and retarded growth. Other manifestations can include chronic anterior uveitis and systemic amyloidosis.

The term "effective amount" is a concentration or amount of a polypeptide and/or agonist/antagonist which results in achieving a particular stated purpose. An "effective amount" of a polypeptide or agonist or antagonist thereof may be determined empirically. Furthermore, a "therapeutically effective amount" is a concentration or amount of a polypeptide and/or agonist/antagonist which is effective for achieving a stated therapeutic effect, which may be achieved in a single dose or multiple doses over time. This amount may also be determined empirically.

The term "cytotoxic agent" as used herein refers to a substance that inhibits or prevents the function of cells and/or causes destruction of cells. The term is intended to include radioactive isotopes (e.g., $I^{131}$, $I^{125}$, $Y^{90}$ and $Re^{186}$), chemotherapeutic agents, and toxins such as enzymatically active toxins of bacterial, fungal, plant or animal origin, or fragments thereof.

A "chemotherapeutic agent" is a chemical compound useful in the treatment of cancer. Examples of chemotherapeutic agents include adriamycin, doxorubicin, epirubicin, 5-fluorouracil, cytosine arabinoside ("Ara-C"), cyclophosphamide, thiotepa, busulfan, cytoxin, taxoids, e.g., paclitaxel (Taxol, Bristol-Myers Squibb Oncology, Princeton, N.J.), and doxetaxel (Taxotere, Rhone-Poulenc Rorer, Antony, France), toxotere, methotrexate, cisplatin, melphalan, vinblastine, bleomycin, etoposide, ifosfamide, mitomycin C, mitoxantrone, vincristine, vinorelbine, carboplatin, teniposide, daunomycin, caminomycin, aminopterin, dactinomycin, mitomycins, esperamicins (see U.S. Pat. No. 4,675,187), melphalan and other related nitrogen mustards. Also included in this definition are hormonal agents that act to regulate or inhibit hormone action on tumors such as tamoxifen and onapristone.

As used herein, the term "inflammatory cells" designates cells that enhance the inflammatory response such as mononuclear cells, eosinophils, macrophages, and polymorphonuclear neutrophils (PMN).

Exemplary Anti-TIGIT Antigen Binding Molecules

FIGS. 2A-2R and 3A-3L depict various sequences of anti-TIGIT antigen binding molecules. In some embodiments, the anti-TIGIT antigen binding molecule (including an anti-TIGIT antibody or antigen binding fragment thereof) results in immune cell activation. In some embodiments, the antigen binding molecule (including an anti-TIGIT antibody or antigen binding fragment thereof) increase the activity of an immune cell. The increase of the activity of an immune cell can be detected using any method known in the art. In one embodiment, the increase in activity of an immune cell can be detected by measuring the proliferation of the immune cell. For example, an increase in activity of a T cell can be detected by measuring the proliferation of the T cell or signal transduction events such as tyrosine phosphorylation of immune receptors or downstream kinases that transmit signals to transcriptional regulators. In some embodiments, the increase in activity of an immune cell can be detected by measuring ctl or nk cell cytotoxic function on specific target cells. In some embodiments, the increase in activity of an immune cell can be detected by measuring t cell activation ex vivo in a sample derived from the subject. In some embodiments, the antigen binding molecule (such as a full length antibody or fragment thereof) includes the paired heavy and light chain sequences. In some embodiments, the antigen binding molecule includes the 3 heavy chain CDRs and the three light chain CDRs noted in FIGS. 2A-3L.

An antagonist anti-TIGIT antigen binding molecule (e.g., an anti-TIGIT antibody or antigen binding fragment thereof) antagonizes an activity of human TIGIT such as by inhibiting TIGIT binding to CD155 and CD112, and inhibiting functional itim signal transduction by TIGIT upon binding to CD155 and CD112. Measurement of anti-tigit antagonist activity can be assessed by demonstrating blocking of t cell suppression following tcr activation induced by TIGIT ligation with cognate ligands CD155 and CD112. Hence, in some embodiments of increased responses, treating with antagonist anti-TIGIT antigen binding molecules (e.g., an anti-TIGIT antibody or antigen binding fragment thereof) are able to rescue it-2 responses to levels observed in t cells that are not repressed by CD155 or CD112 induction of TIGIT. In a more preferred level of activation, responses, following treatment with an anti-TIGIT antagonist antigen binding molecules (e.g., an anti-TIGIT antibody or antigen binding fragment thereof) may increase responses to a level higher than t cell responses not repressed by CD155 or CD112.

In some embodiments, the anti-TIGIT antigen binding molecules (e.g., an anti-TIGIT antibody or antigen binding fragment thereof) are able to block binding of human TIGIT to human CD155 and human CD112. The ability to block binding of human TIGIT to human CD155 and human CD112 can be determined using any method known in the art. In some embodiments, the ability of the antigen binding molecules (e.g., an anti-TIGIT antibody or antigen binding fragment thereof) to block binding of human TIGIT to human CD155 and human CD112 is determined using an ELISA assay.

Also included are polypeptides, e.g., immunoglobulin polypeptides, comprising amino acid sequences that are at least about 75% identical, 80% identical, more preferably at least about 90% identical and most preferably at least about 95% identical (e.g., 95%, 96%, 97%, 98%, 99%, 100%) to the amino acid sequences of the antigen binding molecules (e.g., an anti-TIGIT antibody or antigen binding fragment thereof) provided herein (e.g., an antigen binding molecule that includes one or more of the sequences in FIGS. 2A-3L) when the comparison is performed by a blast algorithm wherein the parameters of the algorithm are selected to give the largest match between the respective sequences over the entire length of the respective reference sequences (e.g. Expect threshold: 10; word size: 3; max matches in a query range: 0; blosum 62 matrix; gap costs: existence 11, extension 1; conditional compositional score matrix adjustment).

Sequence identity refers to the degree to which the amino acids of two polypeptides are the same at equivalent positions when the two sequences are optimally aligned.

The following references relate to blast algorithms often used for sequence analysis: blast algorithms: altschul et al. (2005) febs j. 272(20): 5101-5109; altschul, s. f., et al, (1990) j. Mol. Biol. 215:403-410; gish, w., et al, (1993) nature genet. 3:266-272; madden, t. l., et al, (1996) meth. Enzymol. 266: 131-141; altschul, s. f., et al, (1997) nucleic acids res. 25:3389-3402; zhang, j., et al, (1997) genome res. 7:649-656; wootton, j. c., et al, (1993) comput. Chem. 17: 149-163; hancock, j. m. et al, (1994) comput. Appl. Biosci. 10:67-70; Alignment scoring systems: dayhoff, m. o., et al, "a model of evolutionary change in proteins." in atlas of protein sequence and structure, (1978) vol. 5, suppl. 3. M. o. dayhoff (ed.), pp. 345-352, natl. Biomed. Res. Found., Washington, D.C.; schwartz, r. m., et al, "matrices for detecting distant relationships." in atlas of protein sequence and structure, (1978) vol. 5, suppl. 3." m. o. dayhoff (ed.), pp. 353-358, natl. Biomed. Res. Found., Washington, D.C.; altschul, s. f., (1991) j. Mol. Biol. 219:555-565; states, d. j., et al, (1991) methods 3:66-70; henikoff, s., et al, (1992) proc. Natl. Acad. Sci. USA 89:10915-10919; altschul, s. f., et al, (1993) j. Mol. Evol. 36:290-300; alignment statistics: karlin, s., et al, (1990) proc. Natl. Acad. Sci. USA 87:2264-2268; karlin, s., et al, (1993) proc. Natl. Acad. Sci. Usa 90:5873-5877; dembo, a., et al, (1994) ann. Prob. 22:2022-2039; and altschul, s. f. "evaluating the statistical significance of multiple distinct local alignments." in theoretical and computational methods in genome research (s. Suhai, ed.), (1997) pp. 1-14, plenum, new york.

Binding affinity by way of example, and not limitation, the antigen binding molecules (e.g., an anti-TIGIT antibody or antigen binding fragment thereof) disclosed herein may bind human TIGIT with a $K_D$ value at least as good as about $1 \times 10^{-9}$M (e.g., a $K_D$ value of $1 \times 10^{-9}$M or lower numerically) as determined by surface plasmon resonance (e.g., biacore) or a similar technique (e.g. Kinexa or octet). In one embodiment, the antigen binding molecules (e.g., an anti-TIGIT antibody or antigen binding fragment thereof) disclosed herein may bind human TIGIT with a $K_D$ value at least as good as about $1 \times 10^{-9}$M to about $1 \times 10^{-12}$M as determined by surface plasmon resonance (e.g., biacore) or a similar technique (e.g. Kinexa or octet). In some embodiments, the antigen binding molecules (e.g., an anti-TIGIT antibody or antigen binding fragment thereof) disclosed herein may bind human TIGIT with a $K_D$ value of at about $1 \times 10^{-9}$M to about $1 \times 10^{-12}$M as determined by surface plasmon resonance (e.g., biacore) or a similar technique (e.g. Kinexa or octet). In some embodiments, the antigen binding molecules (e.g., an anti-TIGIT antibody or antigen binding fragment thereof) disclosed herein may bind human TIGIT with a $K_D$ value of at least about 50 pm (i.e, a $K_D$ value of about 50 pm or lower) as determined by biacore or a similar technique. In one embodiment, the antigen binding molecules (e.g., an anti-TIGIT antibody or antigen binding fragment thereof) disclosed herein may bind human TIGIT with a $K_D$ value of at least as good as about 10 pM (e.g., a $K_D$ numerical value of about 10 pm lower) as determined by biacore or a similar technique. In one embodiment, the antigen binding molecules (e.g., an anti-TIGIT antibody or antigen binding fragment thereof) may bind to human TIGIT with a $K_D$ of about 50 pm to about 1 pm as determined by biacore or a similar technique.

The anti-TIGIT antigen binding molecules (e.g., an anti-TIGIT antibody or antigen binding fragment thereof) disclosed herein (e.g., an antigen binding molecule that includes one or more of the sequences in FIGS. 2A-3L) may also be conjugated to a chemical moiety. The chemical moiety may be, inter alia, a polymer, a radionuclide or a cytotoxic factor. In some embodiments, the chemical moiety is a polymer which increases the half-life of the antigen binding molecule (e.g., an anti-TIGIT antibody or antigen binding fragment thereof) in the body of a subject. Suitable polymers include, but are not limited to, hydrophilic polymers which include but are not limited to polyethylene glycol (peg) (e.g., peg with a molecular weight of 2 kda, 5 kda, 10 kda, 12 kda, 20 kda, 30 kda or 40 kda), dextran and monomethoxypolyethylene glycol (mpeg). Lee, et al., (1999) (bioconj. Chem. 10:973-981) discloses peg conjugated single-chain antibodies. Wen, et al., (2001) (bioconj. Chem. 12:545-553) disclose conjugating antibodies with peg which is attached to a radiometal chelator (diethylenetriaminpentaacetic acid (dtp a)).

The antigen binding molecule (e.g., an anti-TIGIT antibody or antigen binding fragment thereof) disclosed herein (e.g., an antigen binding molecule that includes one or more of the sequences in FIGS. 2A-3L) may also be conjugated with labels such as $^{99}$Tc, $^{90}$Yy, $^{111}$In, $^{32}$P, $^{14}$C, $^{125}$L, $^{3}$H, $^{131}$I, $^{11}$C, $^{15}$O, $^{13}$N, $^{18}$F, $^{35}$S, $^{51}$Cr, $^{57}$To, $^{226}$Ra, $^{60}$Co, $^{59}$Fe, $^{57}$Se, $^{152}$Eu, $^{67}$Cu, $^{217}$Ci, $^{211}$At, $^{212}$Pb, $^{47}$Sc, $^{109}$Pd, $^{234}$Th, $^{40}$K, $^{157}$Gd, $^{55}$Mn, $^{52}$Tr, and $^{56}$Fe.

The antigen binding molecule (e.g., an anti-TIGIT antibody or antigen binding fragment thereof) disclosed herein (e.g., an antigen binding molecule that includes one or more of the sequences in FIGS. 2A-3L) may also be pegylated, for example to increase its biological (e.g., serum) half-life. To pegylate, the antigen binding molecule (e.g., an anti-TIGIT antibody or antigen binding fragment thereof), typically is reacted with a reactive form of polyethylene glycol (peg), such as a reactive ester or aldehyde derivative of peg, under conditions in which one or more peg groups become attached to the antigen binding molecule. In particular embodiments, the pegylation is carried out via an acylation reaction or an alkylation reaction with a reactive peg molecule (or an analogous reactive water-soluble polymer). As used herein, the term "polyethylene glycol" is intended to encompass any of the forms of peg that have been used to derivatize other proteins, such as mono (ci-cio) alkoxy- or aryloxy-polyethylene glycol or polyethylene glycol-maleimide. In some embodiments, the antigen binding molecule to be pegylated is an aglycosylated antibody or fragment. Methods for pegylating proteins are known in the art and can be applied to the antibodies. See, e.g., ep 0 154 316 and ep 0 401 384.

The antigen binding molecules (e.g., an anti-TIGIT antibody or antigen binding fragment thereof) disclosed herein (e.g., an antigen binding molecule that includes one or more of the sequences in FIGS. 2A-3L) may also be conjugated with fluorescent or chemiluminescent labels, including fluorophores such as rare earth chelates, fluorescein and its derivatives, rhodamine and its derivatives, isothiocyanate, phycoerythrin, phycocyanin, allophycocyanin, o-phthaladehyde, fluorescamine, $^{152}$Eu, dansyl, umbelliferone, luciferin, luminal label, isoluminal label, an aromatic acridinium ester label, an imidazole label, an acridimium salt label, an oxalate ester label, an aequorin label, 2,3-dihydrophthalazinediones, biotin/avidin, spin labels and stable free radicals.

In some embodiments, an isolated antigen binding molecule that competes for binding to human TIGIT with an antibody that comprises any one or more of a CDR within any of FIGS. 2A, 2B, 2C, 2D, 2E, 2F, 2G, 2H, 2I, 2J, 2K, 2L, 2M, 2N, 2O, 2P, 2Q, 2R, 3A, 3B, 3C, 3D, 3E, 3F, 3G, 3H, 3I, 3J, or 3L is provided. In some embodiments, the isolated antigen binding molecule comprises all 6 CDRs from a single clone in any one of FIGS. 2A, 2B, 2C, 2D, 2E, 2F, 2G, 2H, 2I, 2J, 2K, 2L, 2M, 2N, 2O, 2P, 2Q, 2R, 3A, 3B, 3C, 3D, 3E, 3F 3G, 3H, 3I, 3J, 3K, or 3L. In some embodiments, the isolated antigen binding molecule comprises at least 1, 2, 3, 4, or 5 CDRs from a single clone in any one of FIGS. 2A, 2B, 2C, 2D, 2E, 2F, 2G, 2H, 2I, 2J, 2M, 2N, 2O, 2P, 2Q, 2R, 3A, 3B, 3C, 3D, 3E, 3F, 3G, 3H, 3I, 3J, 3K, or 3L. In some embodiments, the isolated antigen binding molecule comprises a heavy and a light chain variable region from a single clone identified in any one of FIGS. 2A, 2B, 2C, 2D, 2E, 2F, 2G, 2H, 2I, 2J, 2K, 2L, 2M, 2N, 2O, 2P, 2Q or 2R. In addition to the above, the CDR variants described within table 6.1 by position are also embodiments for a TIGIT antigen binding molecule.

In some embodiments, an isolated antigen binding molecule that binds to human TIGIT is provided. The isolated antigen binding molecules comprises a) a heavy chain CDR1 comprising the amino acid sequence of any one of the HCDR1s in FIGS. 3A, 3B, 3C, 3D, 3E, 3F, 3G, 3H, 3I, 3J, 3K, or 3L, b) a heavy chain CDR2 comprising the amino acid sequence of any one of the HCDR2s in FIGS. 3A, 3B, 3C, 3D, 3E, 3F, 3G, 3H, 3I, 3J, 3K, or 3L, and c) a heavy chain CDR3 comprising the amino acid sequence of any one of the HCDR3s in FIGS. 3A, 3B, 3C, 3D, 3E, 3F, 3G, 3H, 3I, 3J, 3K, or 3L. The HCDR1, HCDR2, and HCDR3 are from a same clone.

In some embodiments, an isolated antigen binding molecule that binds to human TIGIT is provided. The isolated antigen binding molecule comprises a) a heavy chain CDR1 comprising the amino acid sequence of any of one of the HCDR1s in FIGS. 3A, 3B, 3C, 3D, 3E, 3F, 3G, 3H, 3I, 3J, 3K, or 3L, b) a heavy chain CDR2 comprising the amino acid sequence of any one of the HCDR2s in FIGS. 3A, 3B, 3C, 3D, 3E, 3F, 3G, 3H, 3I, 3J, 3K, or 3L, c) a heavy chain CDR3 comprising the amino acid sequence of any one of the HCDR3s in FIGS. 3A, 3B, 3C, 3D, 3E, 3F, 3G, 3H, 3I, 3J, 3K, or 3L, d) a light chain CDR1 comprising the amino acid sequence of any one of the LCDR1s in FIGS. 3A, 3B, 3C, 3D, 3E, 3F, 3G, 3H, 3I, 3J, 3K, or 3L, e) a light chain CDR2 comprising the amino acid sequence of any one of the LCDR2s in FIGS. 3A, 3B, 3C, 3D, 3E, 3F, 3G, 3H, 3I, 3J, 3K, or 3L, and f) a light chain CDR3 comprising the amino acid sequence of any one of the LCDR3s in FIGS. 3A, 3B, 3C. 3D, 3E, 3F, 3G, 3H, 3I, 3J, 3K, or 3L. The HCDR1, HCDR2, HCDR3, LCDR1, LCDR2, and LCDR3 are from a same clone.

In some embodiments, an isolated antigen binding molecule that binds to human TIGIT is provided. The isolated antigen binding molecule comprises a heavy chain comprising the heavy chain amino acid variable sequence in any one of FIGS. 2A, 2B, 2C, 2D, 2E, 2F, 2G, 2H, 2I, 2J, 2K, 2L, 2M, 2N, 2O, 2P, 2Q or 2R.

In some embodiments, an isolated antigen binding molecule that binds to human TIGIT is provide. The isolated antigen binding molecule comprises a light chain comprising the light chain amino acid variable sequence in any one of FIGS. 2A, 2B, 2C, 2D, 2E, 2F, 2G, 2H, 2I, 2J, 2K, 2L, 2M, 2N, 2O, 2P, 2Q or 2R.

In some embodiments, an isolated antigen binding molecule that binds to human TIGIT is provided. The isolated antigen binding molecule comprises a heavy chain comprising the heavy chain amino acid variable sequence in any one of FIGS. 2A, 2B, 2C 2D, 2E, 2F, 2G, 2H, 2I, 2J, 2K, 2L, 2M, 2N, 2O, 2P, 2Q or 2R and a light chain comprising the light chain amino acid variable sequence in any one of FIG.S 2A, 2B, 2C, 2D, 2E, 2F, 2G, 2H, 2I, 2J, 2K, 2L, 2M, 2N. 2O, 2P, 2Q or 2R.

In some embodiments, an isolated antigen binding molecule that binds to human TIGIT is provided. The isolated antigen binding molecule comprises a heavy chain CDR1 comprising SSYX$_4$MX$_6$ (SEQ ID NO: 1600; FIG. 5) wherein X$_4$ is A, G, or S and X$_6$ is H, N, or S, and a heavy chain CDR2 comprising WVY$_3$Y$_4$IY$_6$Y$_7$Y$_8$Y$_9$Y$_{10}$Y$_{11}$Y$_{12}$Y$_{13}$ (SEQ ID NO: 1601; FIG. 5) wherein Y$_3$ is S or A, Y$_4$ is G, N, S, Y, or A, Y$_6$ is 5, K, or N, Y$_7$ is 5, Y, or G, Y$_8$ is N or S, Y$_9$ is G, S, A, or T, Y$_{10}$ is G or S, Y$_{11}$ is S, N, or T, Y$_{12}$ is T, K, S, or I, Y$_{13}$ is 5, Y, or G, and a heavy chain CDR3 comprising ARZ$_3$PYZ$_6$Z$_7$WZ$_9$D (SEQ ID NO: 1602; FIG. 5), wherein Z$_3$ is V, A, G, or E, Z$_6$ is 5, D, or G, Z$_7$ is V or Y, and Z$_9$ is I, A, M, or L. In some embodiments, the antigen binding molecule comprises 1, 2, 3, 4, 5, or all 6 of the above CDRs.

In some embodiments, and one or more of the variable positions in the CDRs can be replaced with a conservative substitution.

In some embodiments, an isolated binding molecule that binds to human TIGIT is provided. The isolated antigen binding molecule comprises at least one of: a) (i) a heavy chain variable region comprising the amino acid sequence of SEQ ID NO: 23 and (ii) a light chain variable region comprising the amino acid sequence of SEQ ID NO: 120, b) (i) a heavy chain variable region comprising the amino acid sequence of SEQ ID NO: 29 and (ii) a light chain variable region comprising the amino acid sequence of SEQ ID NO: 126, c) (i) a heavy chain variable region comprising the amino acid sequence of SEQ ID NO: 45 and (ii) a light chain variable region comprising the amino acid sequence of SEQ ID NO: 142, d) (i) a heavy chain variable region comprising the amino acid sequence of SEQ ID NO: 46 and (ii) a light chain variable region comprising the amino acid sequence of SEQ ID NO: 143, e) (i) a heavy chain variable region comprising the amino acid sequence of SEQ ID NO: 58 and (ii) a light chain variable region comprising the amino acid sequence of SEQ ID NO: 155; f) (i) a heavy chain variable region comprising the amino acid sequence of SEQ ID NO: 63 and (ii) a light chain variable region comprising the amino acid sequence of SEQ ID NO: 160, g) (i) a heavy chain variable region comprising the amino acid sequence of SEQ ID NO: 67 and (ii) a light chain variable region comprising the amino acid sequence of SEQ ID NO:164, h) (i) a heavy chain variable region comprising the amino acid sequence of SEQ ID NO: 72 and (ii) a light chain variable region comprising the amino acid sequence of SEQ ID NO: 169, I) (i) a heavy chain variable region comprising the amino acid sequence of SEQ ID NO: 80 and (ii) a light chain variable region comprising the amino acid sequence of SEQ ID NO: 177, or j) (i) a heavy chain variable region that is at least 85% identical to any of the heavy chain variable regions in (a)-(i) and (ii) a light chain variable region that is at least 85% identical to any of the light chain variable regions in (a)-(i).

In some embodiments, an isolated antigen binding molecule that binds to human TIGIT is provided. The isolated antigen binding molecule comprises a heavy chain CDR3 of contiguous amino acids $Z_1Z_2Z_3Z_4Z_5Z_6Z_7Z_8Z_9Z_{10}$ (SEQ ID NO: 1599; FIG. 5) wherein $Z_1$ is A, $Z_2$ is R, $Z_3$ is E, $Z_4$ is P, $Z_5$ is Y, $Z_6$ is D, G, or S, $Z_7$ is V, Y, or T, $Z_9$ is W, $Z_9$ is I, L, or M, and $Z_{10}$ is D. In some embodiments, $Z_6$ is D. In some embodiments, $Z_6$ is G. In some embodiments, $Z_6$ is S. In some embodiments, $Z_7$ is V. In some embodiments, $Z_7$ is Y. In some embodiments, $Z_7$ is T. In some embodiments, $Z_9$ is I. In some embodiments, $Z_9$ is L. In some embodiments, $Z_9$ is M.

In some embodiments, an isolated antibody that comprises: a) a heavy chain CDR1 comprising the amino acid sequence of any of one of the HCDR1s in FIGS. 3A, 3B, 3C, 3D, 3E, 3F, 3G, 3H, 3I, 3J, 3K, or 3L, b) a heavy chain CDR2 comprising the amino acid sequence of any one of the HCDR2s in FIGS. 3A, 3B, 3C, 3D, 3E, 3F, 3G, 3H, 3I, 3J, 3K, or 3L, c) a heavy chain CDR3 comprising the amino acid sequence of any one of the HCDR3s in FIGS. 3A, 3B, 3C, 3D, 3E, 3F, 3G, 3H, 3I, 3J, 3K, or 3L, d) a light chain CDR1 comprising the amino acid sequence of any one of the LCDR1s in FIGS. 3A, 3B, 3C, 3D, 3E, 3F, 3G, 3H, 3I, 3J, 3K, or 3L, e) a light chain CDR2 comprising the amino acid sequence of any one of the LCDR2s in FIGS. 3A, 3B, 3C, 3D, 3E, 3F, 3G, 3H, 3I, 3J, 3K, or 3L, and f) (f) a light chain CDR3 comprising the amino acid sequence of any one of the LCDR3s in FIGS. 3A, 3B, 3C 3D, 3E, 3F, 3G, 3H, 3I, 3J, 3K, or 3L is provided. The HCDR1, HCDR2, HCDR3, LCDR1, LCDR2, and LCDR3 are from a same clone.

In some embodiments, the isolated antibody comprises a heavy chain comprising the heavy chain amino acid variable sequence in any one of FIGS. 2A, 2B, 2C, 2D, 2E, 2F, 2G, 2H, 2I, 2J, 2K, 2L, 2M, 2N, 2O, 2P, 2Q or 2R, or a sequence at least 90% identical thereto.

In some embodiments, the isolated antibody comprises a light chain comprising the light chain amino acid variable sequence in any one of FIGS. 2A, 2B, 2C, 2D, 2E, 2F, 2G, 2H, 2I, 2J, 2K, 2M, 2N, 2O, 2P, 2Q or 2R, or a sequence at least 90% identical thereto.

In some embodiments, the isolated antibody comprises a heavy chain comprising the heavy chain amino acid variable sequence in any one of FIGS. 2A, 2B, 2C, 2D, 2E, 2F, 2G, 2H, 2I, 2J, 2K, 2L, 2m, 2N, 2O, 2P, 2 Q or 2R, or a sequence at least 90% identical thereto, and a light chain comprising the light chain amino acid variable sequence in any one of FIGS. 2A, 2B, 2C, 2D, 2E, 2F, 2G, 2H, 2I, 2J, 2K, 2L, 2M, 2N, 2O, 2P, 2Q or 2R or a sequence at least 90% identical thereto.

In some embodiments, the isolated antigen binding molecule isolated antibody binds to human TIGIT with a $K_D$ of $1 \times 10^{-7}$M or lower (numerically).

In some embodiments, the isolated antigen binding molecule or isolated antibody has antagonist activity to human TIGIT.

In some embodiments, the antigen binding molecule is an antibody. In some embodiments, the antibody is an intact human antibody. In some embodiments, the antibody is an antibody binding fragment. In some embodiments, the antibody is a chimeric or a humanized antibody. In some embodiments, the antibody binds to human TIGIT with a $K_D$ of 100 nM or less (numerically).

In some embodiments, the isolated antigen binding molecule or isolated antibody blocks binding of human TIGIT to human CD155 and human CD112.

In some embodiments, the isolated antigen binding molecule or antibody is a bispecific antibody. In some embodiments, the bispecific antibody further binds to PD-1.

In some embodiments, the isolated antigen binding molecule binds to human TIGIT and comprises at least one of: a) (i) a heavy chain variable region comprising the heavy chain of clone Ab117 and (ii) a light chain variable region comprising the light chain of clone Ab117, b) (i) a heavy chain variable region comprising the heavy chain of clone Ab53 and (ii) a light chain variable region comprising the light chain of clone Ab53, c) (i) a heavy chain variable region comprising the heavy chain of clone Ab40 and (ii) a light chain variable region comprising the light chain of clone Ab40, d) (i) a heavy chain variable region comprising the heavy chain of clone Ab48 and (ii) a light chain variable region comprising the light chain of clone Ab48, e) (i) a heavy chain variable region comprising the heavy chain of clone Ab1 and (ii) a light chain variable region comprising the light chain of clone Ab1, or f) (i) a heavy chain variable region comprising the heavy chain of clone Ab143 and (ii) a light chain variable region comprising the light chain of clone Ab143. In some embodiments, rather than the heavy and light chain variable regions of the above antibodies, the 6 CDRs are present in the antigen binding molecules.

Methods of Therapy

Further provided are methods for treating subjects, including human subjects, in need of treatment with the isolated antigen binding molecules (e.g., an anti-TIGIT antibody or antigen binding fragment thereof) disclosed herein (e.g., an antigen binding molecule that includes one or more of the sequences in FIGS. 2A-3L). In some embodiments, the antigen binding molecule (such as a full length antibody or fragment thereof) includes the paired heavy and light chain sequences. In some embodiments, the antigen binding molecule includes the 3 heavy chain CDRs and the three light chain CDRs noted in FIGS. 2A-3L. In some embodiments, the subject suffers from an infection or an infectious disease. In some embodiments, the subject suffers from cancer. In some embodiments, the cancer is a solid tumor which is infiltrated by tumor-infiltrating lymphocytes which express TIGIT. In some embodiments, the cancer is, e.g., osteosarcoma, rhabdomyosarcoma, neuroblastoma, kidney cancer, leukemia, renal transitional cell cancer, bladder cancer, wilm's cancer, ovarian cancer, pancreatic cancer, breast cancer, prostate cancer, bone cancer, lung cancer (e.g., non-small cell lung cancer), gastric cancer, colorectal cancer, cervical cancer, synovial sarcoma, head and neck cancer, squamous cell carcinoma, multiple myeloma, renal cell cancer, retinoblastoma, hepatoblastoma, hepatocellular carcinoma, melanoma, rhabdoid tumor of the kidney, ewing's sarcoma, chondrosarcoma, brain cancer, glioblastoma, meningioma, pituitary adenoma, vestibular schwannoma, a primitive neuroectodermal tumor, medulloblastoma, astrocytoma, anaplastic astrocytoma, oligodendroglioma, ependymoma, choroid plexus papilloma, polycythemia vera, thrombocythemia, idiopathic myelfibrosis, soft tissue sarcoma, thyroid cancer, endometrial cancer, carcinoid cancer or liver cancer, breast cancer or gastric cancer. In some embodiments, the cancer is metastatic cancer, e.g., of the varieties described above. In some embodiments, a method for treating a subject using an anti-TIGIT antibody or antigen-binding fragment thereof (e.g., an antigen binding molecule that includes one or more of the sequences in FIGS. 2A-3L) is provided. The subject suffers from a viral infection. In some embodiments, the viral infection is infection with a virus selected from the group consisting of human immunodeficiency virus (HIV), hepatitis virus (a, b, or c), herpes virus (e.g., vzv, hsv-i, hav-6, hsv-ii, and cmv, epstein barr virus), adenovirus, influenza virus, flaviviruses, echovirus, rhinovirus, coxsackie virus, coronavirus, respiratory syncytial virus, mumps virus, rotavirus, measles virus, rubella virus, parvovirus, vaccinia virus, htlv virus, dengue virus, papillomavirus, molluscum virus, poliovirus, rabies virus, jc virus or arboviral encephalitis virus.

In some embodiments, methods for treating subjects using an anti-TIGIT antigen binding molecule (e.g., an anti-TIGIT antibody or antigen binding fragment thereof) are provided, wherein the subject suffers from a bacterial infection. In some embodiments, the bacterial infection is infection with a bacteria selected from the group consisting of *chlamydia*, rickettsial bacteria, mycobacteria, staphylococci, streptococci, pneumonococci, meningococci and gonococci, *klebsiella, proteus, serratia, pseudomonas, legionella, Corynebacterium diphtheriae, salmonella*, bacilli, *Vibrio cholerae, clostridium tetan, Clostridium botulinum, bacillus* anthricis, *Yersinia pestis, Mycobacterium leprae, Mycobacterium lepromatosis*, and *borriella*. In some embodiments, methods for treating subjects using an anti-TIGIT antigen binding molecule (e.g., an anti-TIGIT antibody or antigen binding fragment thereof) are provided, wherein the subject suffers from a fungal infection. In some embodiments, the fungal infection is infection with a fungus selected from the group consisting of *candida* (*albicans, krusei, glabrata, tropicalis*, etc.), *cryptococcus neoformans, aspergillus* (*fumigatus, niger*, etc.), genus *mucorales* (*mucor, absidia, rhizopus*), *sporothrix schenkii, blastomyces dermatitidis, paracoccidioides brasiliensis, coccidioides immitis* and *Histoplasma capsulatum*.

In some embodiments, methods for treating subjects using an anti-TIGIT antigen binding molecule (e.g., an anti-TIGIT antibody or antigen binding fragment thereof) are provided, wherein the subject suffers from a parasitic infection. In some embodiments, the parasitic infection is an infection with a parasite selected from the group consisting of *Entamoeba histolytica, Balantidium coli, Naegleria fowleri, acanthamoeba, Giardia lambia, cryptosporidium, Pneumocystis carinii, Plasmodium vivax, Babesia microti, Trypanosoma brucei, Trypanosoma cruzi, Leishmania donovani, Toxoplasma gondii* and *Nippostrongylus brasiliensis*.

In some embodiments, a method for preventing or inhibiting TIGIT binding to MHC class ii, enhancing antigen-specific t-cell activation or stimulating t-cell production of interleukin-2 in a subject (e.g., human), for example, is provided wherein the subject suffers from cancer or infectious disease (e.g., as discussed herein) comprising administering an effective amount of anti-TIGIT antigen binding molecule (e.g., an antigen binding molecule that includes one or more of the sequences in FIGS. 2A-3L), optionally in association with a further chemotherapeutic agent. In some embodiments, any one or more of anti-TIGIT antigen binding molecules can be co-administered with one or more chemotherapeutics, such as any of: adriamycin, doxorubicin, epirubicin, 5-fluorouracil, cytosine arabinoside ("Ara-C"), cyclophosphamide, thiotepa, busulfan, cytoxin, taxoids, e.g., paclitaxel (Taxol, Bristol-Myers Squibb Oncology, Princeton, N.J.), and doxetaxel (Taxotere, Rhone-Poulenc Rorer, Antony, France), toxotere, methotrexate, cisplatin, melphalan, vinblastine, bleomycin, etoposide, ifosfamide, mitomycin C, mitoxantrone, vincristine, vinorelbine, carboplatin, teniposide, daunomycin, caminomycin, aminopterin, dactinomycin, mitomycins, esperamicins (see U.S. Pat. No. 4,675,187), melphalan, other related nitrogen mustards, and hormonal agents that act to regulate or inhibit hormone action on tumors such as tamoxifen and onapristone. In some embodiments, any one or more of the anti-TIGIT antigen binding molecules can be co-administered with other immuno-oncoligic agents, including either or both of anti-PD-1 and anti-PDL-1 antibodies.

In some embodiments, the subject can be a mammal such as a human, dog, cat, horse, cow, mouse, rat, monkey (e.g., cynomolgous monkey, e.g., *Macaca fascicularis*) or rabbit. In preferred embodiments, the subject is a human subject.

In some embodiments, the antigen binding molecule (e.g., an anti-TIGIT antibody or antigen binding fragment thereof) disclosed herein (e.g., an antigen binding molecule that includes one or more of the sequences in FIGS. 2A-3L) can be used alone, or in association with other, further therapeutic agents and/or therapeutic procedures, for treating or preventing any disease such as cancer, e.g., as discussed herein, in a subject in need of such treatment or prevention. Compositions, e.g., pharmaceutical compositions comprising a pharmaceutically acceptable carrier, comprising such antibodies and fragments in association with further therapeutic agents are also contemplated.

In some embodiments, a method of treating a TIGIT related disorder is provided. The method can comprise a) Identifying a subject with a TIGIT related disorder and b) administering an effective dose of an isolated antigen binding molecule or antibody as provided herein to the subject. In some embodiments, the TIGIT related disorder is selected from the group consisting of at least one of: HIV, psoriasis, arthritis, inflammatory bowel disease, and cancer. In some embodiments, the cancer is at least one of: a solid tumor which is infiltrated by tumor-infiltrating lymphocytes which express TIGIT, osteosarcoma, rhabdomyosarcoma, neuroblastoma, kidney cancer, leukemia, renal transitional cell cancer, bladder cancer, Wilm's cancer, ovarian cancer, pancreatic cancer, breast cancer, prostate cancer, bone cancer, lung cancer, non-small cell lung cancer, gastric cancer, colon cancer, colorectal cancer, cervical cancer, synovial sarcoma, head and neck cancer, squamous cell carcinoma, multiple myeloma, renal cell cancer, retinoblastoma, hepatoblastoma, hepatocellular carcinoma, melanoma, rhabdoid tumor of the kidney, Ewing's sarcoma, chondrosarcoma, brain cancer, glioblastoma, meningioma, pituitary adenoma, vestibular schwannoma, a primitive neuroectodermal tumor, medulloblastoma, astrocytoma, anaplastic astrocytoma, oligodendroglioma, ependymoma, choroid plexus papilloma, polycythemia vera, thrombocythemia, idiopathic myelfibrosis, soft tissue sarcoma, thyroid cancer, endometrial cancer, carcinoid cancer or liver cancer, breast cancer, gastric cancer, a metastatic cancer of the varieties described above.

In some embodiments, a method of enhancing T-cell activation is provided. The method comprises a) diagnosing an individual with low T-cell counts and b) administering an effective dose of the isolated antigen binding molecule or isolated antibody as provided herein. In some embodiments, T-cell activation is of CD8+ T cells.

In some embodiments, a method of preventing, treating and/or lessening the severity of an immune-related disease relating to aberrant immune cell response in a subject is provided. The method comprises modulating the activity of TIGIT in the subject by administering an effective amount of any one or more of the isolated antigen binding molecules or antibodies provided herein.

In some embodiments, a method of increasing or stimulating an immune response is provided. The method includes administering in vitro or in vivo an antagonist of TIGIT activity, and/or by inhibiting intracellular signaling mediated by TIGIT binding to PVR (aka CD155), wherein the antagonist of TIGIT activity is any one or more of the isolated antigen binding molecules or isolated antibodies as provided herein.

In some embodiments, a method of increasing T cell activation is provided. The method comprises administering any one or more of the isolated antigen binding molecules or isolated antibodies provided herein to a subject in an amount sufficient to block TIGIT in the subject.

In some embodiments, a method of treating an infection or infectious disease in a human subject is provided. The method comprises administering to a subject who has an infectious disease an effective amount of the isolated antigen binding molecule or isolated antibody as provided herein.

In some embodiments, a method for increasing an effectiveness of a vaccine is provided. The method comprises administering a vaccine to a subject and administering any one or more of the isolated antigen binding molecules or antibodies provided herein to the subject in an amount sufficient to serve as an adjuvant for the vaccine.

In some embodiments, a method for treating an infection is provided. The method comprises identifying a subject that has a viral infection, a bacterial infection, parasitic infection, and/or a fungal infection, and administering any one or more of the antigen binding molecules or isolated antibodies provided herein to the subject in an amount and for a duration sufficient to treat the viral infection, the bacterial infection, the parasitic infection, and/or the fungal infection. In some embodiments, In some embodiments, the viral infection is an infection with a virus selected from the group consisting of at least one of: human immunodeficiency virus (HIV), hepatitis virus (A, B, or C), herpes virus (e.g., VZV, HSV-I, HAV-6, HSV-II, and CMV, Epstein Barr virus), adenovirus, influenza virus, flaviviruses, echovirus, rhinovirus, coxsackie virus, coronavirus, respiratory syncytial virus, mumps virus, rotavirus, measles virus, rubella virus, parvovirus, vaccinia virus, HTLV virus, dengue virus, papillomavirus, molluscum virus, poliovirus, rabies virus, JC virus and arboviral encephalitis virus. In some embodiments, the bacterial infection is infection with a bacteria selected from the group consisting of at least one or: *Chlamydia*, rickettsial bacteria, mycobacteria, staphylococci, streptococci, pneumonococci, meningococci and gonococci, *klebsiella, proteus, serratia, pseudomonas, Legionella, Corynebacterium diphtheriae, Salmonella*, bacilli, *Vibrio cholerae, Clostridium tetan, Clostridium botulinum, Bacillus anthricis, Yersinia pestis, Mycobacterium leprae, Mycobacterium lepromatosis*, and *Borriella*. In some embodiments, the fungal infection is infection with a fungus selected from the group consisting of at least one of: *Candida* (*albicans, krusei, glabrata, tropicalis*, etc.), *Cryptococcus neoformans, Aspergillus* (*fumigatus, niger*, etc.), Genus *Mucorales* (*mucor, absidia, rhizopus*), *Sporothrix schenkii, Blastomyces dermatitidis, Paracoccidioides brasiliensis, Coccidioides immitis*, and *Histoplasma capsulatum*. In some embodiments, the parasitic infection is infection with a parasite selected from the group consisting of at least one of: *Entamoeba histolytica, Balantidium coli, Naegleria fowleri, Acanthamoeba, Giardia lambia, Cryptosporidium, Pneumocystis carinii, Plasmodium vivax, Babesia microti, Trypanosoma brucei, Trypanosoma cruzi, Leishmania donovani, Toxoplasma gondii*, and *Nippostrongylus brasiliensis*.

In some embodiments, a method for preventing and/or inhibiting TIGIT binding to MHC class II to enhance antigen-specific T-cell activation or stimulating T-cell production of interleukin-2 in a subject is provided. The method comprises administering any one or more of the antigen binding molecules to a subject in an amount sufficient for preventing and/or inhibiting TIGIT binding to MHC class II in the subject.

In some embodiments, a method of preventing, treating and/or lessening the severity of a disease in a subject is provided. The method comprises modulating the activity of TIGIT in the subject by administering an effective amount of any one or more of the isolated antigen binding molecules or isolated antibodies provided herein. The disease is selected from the group consisting of: systemic lupus erythematosis, rheumatoid arthritis, juvenile chronic arthritis, spondyloarthropathies, systemic sclerosis (scleroderma), idiopathic inflammatory myopathies (dermatomyositis, polymyositis), Sjogren's syndrome, systemic vasculitis, sarcoidosis, autoimmune hemolytic anemia (immune pancytopenia, paroxysmal nocturnal hemoglobinuria), autoimmune thrombocytopenia (idiopathic thrombocytopenic purpura, immune-mediated thrombocytopenia), thyroiditis (Grave's disease, Hashimoto's thyroiditis, juvenile lymphocytic thyroiditis, atrophic thyroiditis), diabetes mellitus, immune-mediated renal disease (glomerulonephritis, tubulointerstitial nephritis), demyelinating diseases of the central and peripheral nervous systems such as multiple sclerosis, idiopathic demyelinating polyneuropathy or Guillain-Barre syndrome, and chronic inflammatory demyelinating polyneuropathy, hepatobiliary diseases such as infectious hepatitis (hepatitis A, B, C, D, E and other non-hepatotropic viruses), autoimmune chronic active hepatitis, primary biliary cirrhosis, granulomatous hepatitis, and sclerosing cholangitis, inflammatory bowel disorder (IBD) (ulcerative colitis: Crohn's disease), gluten-sensitive enteropathy, and Whipple's disease, autoimmune or immune-mediated skin diseases including bullous skin diseases, erythema multiforme and contact dermatitis, psoriasis, allergic diseases such as asthma, allergic rhinitis, atopic dermatitis, food hypersensitivity and urticaria, immunologic diseases of the lung such as eosinophilic pneumonias, idiopathic pulmonary fibrosis and hypersensitivity pneumonitis, transplantation associated diseases including graft rejection and graft-versus-host-disease. Infectious diseases including viral diseases such as AIDS (HIV infection), hepatitis A, B, C, D, and E, herpes, etc., bacterial infections, fungal infections, protozoal infections and parasitic infections also may have immune and/or inflammatory components and/or etiology.

Pharmaceutical Compositions

To prepare pharmaceutical or sterile compositions of the anti-TIGIT antigen binding molecule (e.g., an anti-TIGIT antibody or antigen binding fragment thereof that includes one or more of the sequences in FIGS. 2A-3L) is admixed with a pharmaceutically acceptable carrier or excipient. See, e.g., Remington's Pharmaceutical Sciences and U.S. Pharmacopeia: National Formulary, Mack Publishing Company, Easton, Pa. (1984). Formulations of therapeutic and diagnostic agents may be prepared by mixing with acceptable carriers, excipients, or stabilizers in the form of, e.g., lyophilized powders, slurries, aqueous solutions or suspensions (see, e.g., Hardman, et al. (2001) Goodman and Gilman's The Pharmacological Basis of Therapeutics, McGraw-Hill, New York, N.Y.; Gennaro (2000) Remington: The Science and Practice of Pharmacy, Lippincott, Williams, and Wilkins, New York, N.Y.; Avis, et al. (eds.) (1993) Pharmaceutical Dosage Forms: Parenteral Medications, Marcel Dekker, NY; Lieberman, et al. (eds.) (1990) Pharmaceutical Dosage Forms: Tablets, Marcel Dekker, NY; Lieberman, et al. (eds.) (1990) Pharmaceutical Dosage Forms: Disperse Systems, Marcel Dekker, NY; Weiner and Kotkoskie (2000) Excipient Toxicity and Safety, Marcel Dekker, Inc., New York, N.Y.).

Toxicity and therapeutic efficacy of the antigen binding molecule (e.g., an anti-TIGIT antibody or antigen binding fragment thereof), administered alone or in combination with another therapeutic agent, can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index (LD50/ED50). The data obtained from these cell culture assays and animal studies can be used in formulating a range of dosage for use in human. The dosage of such compounds lies preferably within a range of circulating concentrations that include the $ED_{50}$ with little or no toxicity. The dosage may vary within this range depending upon the dosage form employed and the route of administration.

In some embodiments, a further therapeutic agent that is administered to a subject in association with an anti-TIGIT antigen binding molecule in accordance with the Physicians' Desk Reference 2003 (Thomson Healthcare; 57th edition (Nov. 1, 2002)). The mode of administration can vary. Routes of administration include oral, rectal, transmucosal, intestinal, parenteral; intramuscular, subcutaneous, intradermal, intramedullary, intrathecal, direct intraventricular, intravenous, intraperitoneal, intranasal, intraocular, inhalation, insufflation, topical, cutaneous, transdermal, or intraarterial.

In some embodiments, the anti-TIGIT antigen binding molecule (e.g., an anti-TIGIT antibody or antigen binding fragment thereof that includes one or more of the sequences in FIGS. 2A-3L) can be administered by an invasive route such as by injection. In some embodiments, an anti-TIGIT antigen binding molecule (e.g., an anti-TIGIT antibody or antigen binding fragment thereof), or pharmaceutical composition thereof, is administered intravenously, subcutaneously, intramuscularly, intraarterially, intratumorally, or by inhalation, aerosol delivery. Administration by non-invasive routes (e.g., orally; for example, in a pill, capsule or tablet) is also an option.

In some embodiments, a composition is provided. The composition comprises an isolated antigen binding molecule (such as an antibody) as provided herein in an amount that is pharmaceutically acceptable and a pharmaceutically acceptable carrier.

Polynucleotides

Provided herein are polynucleotides encoding any of the polypeptides or immunoglobulin chains of anti-TIGIT antigen binding molecule (e.g., an anti-TIGIT antibody or antigen binding fragment thereof). For example, various embodiments include the polynucleotides encoding the amino acids described in FIGS. 2A, 2B, 2C, 2D, 2E, 2F, 2G, 2H, 2I, 2J, 2K, 2L, 2M, 2N, 2O, 2P, 2Q, 2R, 3A, 3B, 3C, 3D, 3E, 3F, 3G, 3H, 3I, 3J, 3K, and 3L, as well as polynucleotides which hybridize thereto and, also, any polypeptide encoded by such a hybridizing polynucleotide.

In general, the polynucleotides hybridize under low, moderate or high stringency conditions, and encode antigen binding molecules (e.g., an anti-TIGIT antibody or antigen binding fragment thereof) that maintain the ability to bind to TIGIT (human, rhesus and/or cynomolgous monkey, e.g., *Macaca fascicularis*). A first polynucleotide molecule is "hybridizable" to a second polynucleotide molecule when a single stranded form of the first polynucleotide molecule can anneal to the second polynucleotide molecule under the appropriate conditions of temperature and solution ionic strength (see Sambrook, et al., supra). The conditions of temperature and ionic strength determine the "stringency" of the hybridization. Typical low stringency hybridization conditions include 55° C., 5×SSC, 0.1% SDS and no formamide; or 30% formamide, 5×SSC, 0.5% SDS at 42° C. Typical moderate stringency hybridization conditions are 40% formamide, with 5× or 6×SSC and 0.1% SDS at 42° C. High stringency hybridization conditions are 50% formamide, 5× or 6×SSC at 42° C. or, optionally, at a higher temperature (e.g., 57° C., 59° C., 60° C., 62° C., 63° C., 65° C. or 68° C.). In general, SSC is 0.15M NaCl and 0.015M Na-citrate. Hybridization requires that the two polynucleotide contain complementary sequences, although, depending on the stringency of the hybridization, mismatches between bases are possible. The appropriate stringency for hybridizing polynucleotides depends on the length of the polynucleotides and the degree of complementation, variables well known in the art. The greater the degree of similarity or homology between two nucleotide sequences, the higher the stringency under which the nucleic acids may hybridize. For hybrids of greater than 100 nucleotides in length, equations for calculating the melting temperature have been derived (see Sambrook, et al., supra, 9.50-9.51). For hybridization with shorter polynucleotides, e.g., oligonucleotides, the position of mismatches becomes more important, and the length of the oligonucleotide determines its specificity (see Sambrook, et al., supra, 11.7-11.8).

In some embodiments, an isolated polynucleotide, for example DNA, encoding the polypeptide chains of the isolated antigen binding molecule (e.g., an anti-TIGIT antibody or antigen binding fragment thereof) set forth herein is provided. In some embodiments, the isolated polynucleotide encodes an antigen binding molecule (e.g., an anti-TIGIT antibody or antigen binding fragment thereof) comprising at least one mature immunoglobulin light chain variable (VL) domain according including the sequences provided herein and/or at least one mature immunoglobulin heavy chain variable (VH) domain including the sequences provided herein. In some embodiments the isolated polynucleotide encodes both a light chain and a heavy chain on a single polynucleotide molecule, and in other embodiments the light and heavy chains are encoded on separate polynucleotide molecules. In another embodiment the polynucleotides further encodes a signal sequence. In some embodiments, the polynucleotide encodes one or more of the CDR sequences provided in any one of FIGS. 2A-3L.

Further envisioned are vectors, e.g., expression vectors, such as plasmids, comprising the above isolated polynucleotides, wherein the polynucleotide is operably linked to control sequences that are recognized by a host cell when the host cell is transfected with the vector. Also provided are host cells comprising such a vector and methods for producing the antigen binding molecule (e.g., an anti-TIGIT antibody or antigen binding fragment thereof) or polypeptide disclosed herein comprising culturing a host cell harboring an expression vector or a nucleic acid encoding the immunoglobulin chains of the antigen binding molecule (e.g., an anti-TIGIT antibody or antigen binding fragment thereof) in culture medium, and isolating the antigen or antigen-binding fragment thereof from the host cell or culture medium.

Methods of Making

In some embodiments, a method of making an isolated antigen binding molecule that binds to human TIGIT is provided. The method comprises providing a nucleic acid that encodes for the isolated antigen binding molecule or isolated antibody provided herein, and expressing a protein encoded by the nucleic acid. In some embodiments, the isolated antigen binding molecule is expressed in a CHO cell.

Hybridoma cells that produce parental (e.g., rat or mouse) monoclonal anti-TIGIT antigen binding molecule (e.g., an anti-TIGIT antibody or antigen binding fragment thereof) discussed herein may be produced by methods which are known in the art. Such isolated hybridomas are also contemplated in regard to the sequences provided in FIGS. 2A-3L. The methods include, but are not limited to, the hybridoma technique originally developed by Kohler, et al., (1975) (Nature 256:495-497), as well as the trioma technique (Hering, et al., (1988) Biomed. Biochim. Acta. 47:211-216 and Hagiwara, et al., (1993) Hum. Antibod. Hybridomas 4: 15), the human B-cell hybridoma technique (Kozbor, et al., (1983) Immunology Today 4:72 and Cote, et al., (1983) Proc. Natl. Acad. Sci. U.S.A 80:2026-2030), the EBV-hybridoma technique (Cole, et al., in Monoclonal Antibodies and Cancer Therapy, Alan R. Liss, Inc., pp. 77-96, 1985), and electric field based electrofusion using a Cyto Pulse large chamber cull fusion electroporator (Cyto Pulse Sciences, Inc., Glen Burnie, Md.).

Preferably, mouse splenocytes are isolated and fused with PEG or by electrofusion to a mouse myeloma cell line based upon standard protocols. The resulting hybridomas may then be screened for the production of antigen-specific antibodies. For example, single cell suspensions of splenic lymphocytes from immunized mice may by fused to one-sixth the number of P3X63-Ag8.653 nonsecreting mouse myeloma cells (ATCC, CRL 1580) with 50% PEG. Cells may be plated at approximately 2×10<5> cells/mL in a flat bottom microtiter plate, followed by a two week incubation in selective medium containing 20% fetal Clone Serum, 18% "653" conditioned media, 5% origen (IGEN), 4 mM L-glutamine, 1 mM L-glutamine, 1 mM sodium pyruvate, 5 mM HEPES, 0.055 mM 2-mercaptoethanol, 50 units/ml penicillin, 50 mg/ml streptomycin, 50 mg/ml gentamycin and IX HAT (Sigma; the HAT is added 24 hours after the fusion). After two weeks, cells may be cultured in medium in which the HAT is replaced with HT. Individual wells may then be screened by ELISA for anti-TIGIT monoclonal IgG antibodies. Once extensive hybridoma growth occurs, medium can be observed usually after 10-14 days. The antibody secreting hybridomas may be replated, screened again, and if still positive for human IgG, anti-TIGIT monoclonal antibodies, can be subcloned at least twice by limiting dilution. The stable subclones may then be cultured in vitro to generate small amounts of antibody in tissue culture medium for characterization.

Thus, methods for making an anti-TIGIT antigen binding molecules (e.g., an anti-TIGIT antibody or antigen binding fragment thereof) are contemplated and comprise culturing a hybridoma cell that expresses the antigen binding molecule under conditions favorable to such expression and, optionally, isolating the antigen binding molecule from the hybridoma and/or the growth medium (e.g. cell culture medium).

The anti-TIGIT antigen binding molecules disclosed herein may also be produced recombinantly (e.g., in an E. coli/YI expression system, a mammalian cell expression system or a lower eukaryote expression system). In some embodiments, nucleic acids encoding the antibody immunoglobulin molecules (e.g., VH or VL or the relevant CDRs) may be inserted into a pET-based plasmid and expressed in the E. coli/T7 system. For example, methods for expressing an antigen binding molecule or immunoglobulin chain thereof in a host cell (e.g., bacterial host cell such as E. coli such as BL21 or BL21DE3) comprise expressing T7 RNA polymerase in the cell which also includes a polynucleotide encoding an immunoglobulin chain that is operably linked to a T7 promoter. For example, a bacterial host cell, such as a E. coli, includes a polynucleotide encoding the T7 RNA polymerase gene operably linked to a lac promoter and expression of the polymerase and the chain is induced by incubation of the host cell with IPTG (isopropyl-beta-D-thiogalactopyranoside).

There are several methods by which to produce recombinant antibodies which are known in the art. One example of a method for recombinant production of antibodies is disclosed in U.S. Pat. No. 4,816,567.

Transformation can be achieved by any known method for introducing polynucleotides into a host cell. Methods for introduction of heterologous polynucleotides into mammalian cells are well known in the art and include dextran-mediated transfection, calcium phosphate precipitation, polybrene-mediated transfection, protoplast fusion, electroporation, encapsulation of the polynucleotide(s) in liposomes, biolistic injection and direct microinjection of the DNA into nuclei. In addition, nucleic acid molecules may be introduced into mammalian cells by viral vectors. Methods of transforming cells are well known in the art. See, for example, U.S. Pat. Nos. 4,399,216; 4,912,040; 4,740,461 and 4,959,455.

In some embodiments, recombinant methods for making an anti-TIGIT antigen binding molecules, or an immunoglobulin chain thereof, comprise introducing a polynucleotide encoding one or more immunoglobulin chains of the antigen binding molecule (e.g., heavy and/or light immunoglobulin chain); culturing the host cell (e.g., CHO or *Pichia* or *Pichia pastoris*) under condition favorable to such expression and, optionally, isolating the antigen binding molecule or chain from the host cell and/or medium in which the host cell is grown. Anti-TIGIT antigen binding molecules can also be synthesized by any of the methods set forth in U.S. Pat. No. 6,331,415.

Eukaryotic and prokaryotic host cells, including mammalian cells as hosts for expression of the antigen binding molecules (including immunoglobulin chains) disclosed herein are well known in the art and include many immortalized cell lines available from the American Type Culture Collection (ATCC). These include, inter alia, Chinese hamster ovary (CHO) cells, NS0, SP2 cells, HeLa cells, baby hamster kidney (BHK) cells, monkey kidney cells (COS), human hepatocellular carcinoma cells (e.g., Hep G2), A549 cells, 3T3 cells, HEK-293 cells and a number of other cell lines. Mammalian host cells include human, mouse, rat, dog, monkey, pig, goat, bovine, horse and hamster cells. Cell lines of particular preference are selected through determining which cell lines have high expression levels. Other cell lines that may be used are insect cell lines, such as Sf9 cells, amphibian cells, bacterial cells, plant cells and fungal cells. Fungal cells include yeast and filamentous fungus cells including, for example, *Pichia pastoris, Pichia finlandica, Pichia trehalophila, Pichia koclamae, Pichia membranaefaciens, Pichia minuta (Ogataea minuta, Pichia lindneri), Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha, Kluyveromyces* sp., *Kluyveromyces lactis, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Physcomitrella patens* and *Neurospora crassa. Pichia* sp., any *Saccharomyces* sp., *Hansenula polymorpha*, any *Kluyveromyces* sp., *Candida albicans*, any *Aspergillus* sp., *Trichoderma reesei, Chrysosporium lucknowense*, any *Fusarium* sp., *Yarrowia lipolytica*, and *Neurospora crassa*. When recombinant expression vectors encoding the heavy chain or antigen-binding portion or fragment thereof, the light chain and/or antigen-binding fragment thereof are introduced into mammalian host cells, the antigen binding molecules are produced by culturing the host cells for a period of time sufficient to allow for expression of the antigen binding molecule or chain in the host cells or secretion of the into the culture medium in which the host cells are grown.

Antigen binding molecules and immunoglobulin chains can be recovered from the culture medium using standard protein purification methods. Further, expression of antigen binding molecules (including immunoglobulin chains (or other moieties therefrom)) from production cell lines can be enhanced using a number of known techniques. For example, the glutamine synthetase gene expression system (the GS system) is a common approach for enhancing expression under certain conditions. The GS system is discussed in whole or part in connection with European Patent Nos. 0 216 846, 0 256 055, and 0 323 997 and European Patent Application No. 89303964.4. Thus, in some embodiments, the mammalian host cells {e.g., CHO) lack a glutamine synthetase gene and are grown in the absence of glutamine in the medium wherein, however, the polynucleotide encoding the immunoglobulin chain comprises a glutamine synthetase gene which complements the lack of the gene in the host cell.

Methods for purifying an anti-TIGIT antigen binding molecule can comprise introducing a sample comprising the antigen binding molecule to a purification medium (e.g., cation exchange medium, anion exchange medium, hydrophobic exchange medium, affinity purification medium (e.g., protein-A, protein-G, protein-A/G, protein-L)) and either collecting purified antigen binding molecule from the flow-through fraction of said sample that does not bind to the medium; or, discarding the flow-through fraction and eluting bound antigen binding molecule from the medium and collecting the eluate. In some embodiments, the medium is in a column to which the sample is applied. In some embodiments, the purification method is conducted following recombinant expression of the antigen binding molecule in a host cell, e.g., wherein the host cell is first lysed and, optionally, the lysate is purified of insoluble materials prior to purification on a medium.

In general, glycoproteins produced in a particular cell line or transgenic animal will have a glycosylation pattern that is characteristic for glycoproteins produced in the cell line or transgenic animal. Therefore, the particular glycosylation pattern of an antibody will depend on the particular cell line or transgenic animal used to produce the antibody. In some embodiments, antibodies with a glycosylation pattern comprising only non-fucosylated N-glycans may be advantageous, because these antibodies have been shown to typically exhibit more potent efficacy than their fucosylated counterparts both in vitro and in vivo {See for example, Shinkawa et al., J. Biol. Chem. 278: 3466-3473 (2003); U.S. Pat. Nos. 6,946,292 and 7,214,775). These antibodies with non-fucosylated N-glycans are not likely to be immunogenic because their carbohydrate structures are a normal component of the population that exists in human serum IgG.

Provided herein are polyclonal anti-TIGIT antibodies and antigen-binding fragments thereof, e.g., a composition comprising a plurality of anti-TIGIT antibodies and fragments, which include one or more of the anti-TIGIT antibodies or antigen-binding fragments thereof. A polyclonal antibody is an antibody which was produced among or in the presence of one or more other, non-identical antibodies. In general, polyclonal antibodies are produced from collections of different B-lymphocytes, e.g., the B-lymphocyte of an animal treated with an immunogen of interest, which produces a population of different antibodies but which are all directed to the immunogen. Usually, polyclonal antibodies are obtained directly from an immunized animal, e.g., spleen, serum or ascites fluid.

The antigen binding molecules disclosed herein (e.g., an antigen binding molecule that includes one or more of the sequences in FIGS. 2A-3L) also include antigen binding molecules with modified (or blocked) Fc regions to provide altered effector functions. See, e.g., U.S. Pat. No. 5,624,821; WO2003/086310; WO2005/120571; WO2006/0057702. Such modifications can be used to enhance or suppress various reactions of the immune system, with possible beneficial effects in diagnosis and therapy. Alterations of the Fc region include amino acid changes (substitutions, deletions and insertions), glycosylation or deglycosylation, and adding multiple Fc regions. Changes to the Fc can also alter the half-life of antigen binding molecules in therapeutic antigen binding molecules, enabling less frequent dosing and thus increased convenience and decreased use of material. See Presta (2005) J. Allergy Clin. Immunol. 116:731 at 734-35.

In some embodiments, the Fc region of an anti-TIGIT antibody is modified to increase the ability of the antibody or antigen-binding fragment to mediate effector function and/or to increase their binding to the Fcgamma receptors (FcyRs).

The term "Effector Function" as used herein is meant to refer to one or more of Antibody Dependant Cell mediated Cytotoxic activity (ADCC), Complement-dependant cytotoxic activity (CDC) mediated responses, Fc-mediated phagocytosis or antibody dependant cellular phagocytosis (ADCP) and antibody recycling via the FcRn receptor.

The interaction between the constant region of an antigen binding protein and various Fc receptors (FcR) including FcgammaRI (CD64), FcgammaRII (CD32) and FcgammaRIII (CD 16) is believed to mediate the effector functions, such as ADCC and CDC, of the antigen binding protein. The Fc receptor is also important for antibody cross-linking, which can be important for anti-tumor immunity.

Effector function can be measured in a number of ways including for example via binding of the FcgammaRIII to Natural Killer cells or via FcgammaRI to monocytes/macrophages to measure for ADCC effector function. For example an antigen binding protein can be assessed for ADCC effector function in a Natural Killer cell assay. Examples of such assays can be found in Shields et al, 2001 J. Biol. Chem., Vol. 276, p 6591-6604; Chappel et al, 1993 J. Biol. Chem., Vol 268, p 25124-25131; Lazar et al, 2006 PNAS, 103; 4005-4010.

The ADCC or CDC properties of antibodies, or their cross-linking properties, may be enhanced in a number of ways.

Human IgG1 constant regions containing specific mutations or altered glycosylation on residue Asn297 have been shown to enhance binding to Fc receptors. In some cases these mutations have also been shown to enhance ADCC and CDC (Lazar et al. PNAS 2006, 103; 4005-4010; Shields et al. J Biol Chem 2001, 276; 6591-6604; Nechansky et al. Mol Immunol, 2007, 44; 1815-1817).

In some embodiments, such mutations are in one or more of positions selected from 239, 332 and 330 (IgG1), or the equivalent positions in other IgG isotypes. Examples of suitable mutations are S239D and I332E and A330L. In some embodiments, the antibody herein described is mutated at positions 239 and 332, for example S239D and I332E or in a further embodiment it is mutated at three or more positions selected from 239 and 332 and 330, for example S239D and I332E and A330L. (EU index numbering).

In some embodiments, there is provided an antibody comprising a heavy chain constant region with an altered glycosylation profile such that the antigen binding protein has enhanced effector function. For example, wherein the antibody has enhanced ADCC or enhanced CDC or wherein it has both enhanced ADCC and CDC effector function. Examples of suitable methodologies to produce antigen binding proteins with an altered glycosylation profile are described in WO2003011878, WO2006014679 and EP1229125.

Kits

Further provided are kits comprising one or more components that include, but are not limited to, an anti-TIGIT antigen binding molecule (e.g., an antibody or antigen binding fragment thereof, that includes one or more of the sequences in FIGS. 2A-3L) in association with one or more additional components including, but not limited to a pharmaceutically acceptable carrier and/or a therapeutic agent. The antigen binding molecule and/or the therapeutic agent can be formulated as a pure composition or in combination with a pharmaceutically acceptable carrier, in a pharmaceutical composition.

In some embodiments, a kit for determining the presence of human TIGIT is provided. The kit can comprise an isolated antigen binding molecule or isolated antibody as provided herein and a detectable marker.

In some embodiments, the kit includes an anti-TIGIT antigen binding molecule (e.g., an antibody or antigen binding fragment thereof, that includes one or more of the sequences in FIGS. 2A-3L) or a pharmaceutical composition thereof in one container (e.g., in a sterile glass or plastic vial) and a pharmaceutical composition thereof and/or a therapeutic agent in another container (e.g., in a sterile glass or plastic vial).

In some embodiments, the kit comprises a combination, including an anti-TIGIT antigen binding molecule (e.g., an antibody or antigen binding fragment thereof that includes one or more of the sequences in FIGS. 2A-3L) along with a pharmaceutically acceptable carrier, optionally in combination with one or more therapeutic agents formulated together, optionally, in a pharmaceutical composition, in a single, common container.

If the kit includes a pharmaceutical composition for parenteral administration to a subject, the kit can include a device for performing such administration. For example, the kit can include one or more hypodermic needles or other injection devices as discussed above.

The kit can include a package insert including information concerning the pharmaceutical compositions and dosage forms in the kit. Generally, such information aids patients and physicians in using the enclosed pharmaceutical compositions and dosage forms effectively and safely. For example, the following information regarding a combination of the antigen binding molecule can be supplied in the insert: pharmacokinetics, pharmacodynamics, clinical studies, efficacy parameters, indications and usage, contraindications, warnings, precautions, adverse reactions, overdosage, proper dosage and administration, how supplied, proper storage conditions, references, manufacturer/distributor information and patent information.

EXAMPLES

Example 1

Biochemical Binding Assays

Binding affinities for antigen binding to anti-TIGIT monoclonal antibodies were determined by ELISA. His-tagged recombinant proteins, Mouse or Human TIGIT were coated on Immunolon 384-well plates at a concentration of 0.5 µg/mL in 1× coating buffer. Antibodies to be tested were diluted to 1 µM in PBS buffer containing 1% BSA and diluted 3-fold in a 10-point curve. Detection of the antibody binding to the antigen was performed using biotinylated goat anti-human kappa light chain. Detection of the secondary antibody was determined using streptavidin-HRP and TMB reagent. All assays were performed at room temperature. Curve-fitting software was used to determine the $EC_{50}$ for each antibody. Data from these assays is shown in Tables 1.1-1.3. Lower values indicate superior binding activity and the units are in microM.

TABLE 1.1

(ARE)

| clone | Goat anti-HuKappa | ELISA-Human TIGIT, 10 pt | ELISA-Mouse TIGIT, 10 pt |
|---|---|---|---|
| Ab58 | 3.647 | 0.6869 | 0.1695 |
| Ab69 | 3.774 | >1 μM | >1 μM |
| Ab75 | 3.778 | >1 μM | >1 μM |
| Ab133 | 3.902 | >1 μM | >1 μM |
| Ab177 | 3.525 | 0.0283 | 0.4387 |
| Ab122 | 3.937 | 0.1347 | >1 μM |
| Ab86 | 3.753 | 0.2643 | 0.0838 |
| Ab180 | 3.741 | 0.0223 | 0.0784 |
| Ab83 | 3.959 | inconclusive | inconclusive |
| Ab26 | 3.813 | 0.0533 | 0.0475 |
| Ab20 | 3.602 | 0.033 | 0.0327 |
| Ab147 | 3.893 | >1 μM | >1 μM |
| Ab12 | 3.724 | 0.0277 | >1 μM |
| Ab66 | 3.825 | 0.2596 | >1 μM |
| Ab176 | 3.61 | 0.0206 | 0.1871 |
| Ab96 | 3.852 | 0.2106 | 0.3444 |
| Ab123 | 3.936 | 0.43 | 0.5777 |
| Ab109 | 3.955 | >1 μM | >1 μM |
| Ab149 | 3.175 | >1 μM | 0.052 |
| Ab34 | 3.638 | 0.0087 | 0.105 |
| Ab61 | 3.842 | 0.1125 | >1 μM |
| Ab64 | 3.851 | 0.229 | inconclusive |
| Ab105 | 3.887 | >1 μM | >1 μM |
| Ab108 | 3.914 | 0.8345 | 0.6831 |
| Ab178 | 3.554 | 0.0061 | 0.024 |
| Ab166 | 3.613 | 0.0041 | 0.0104 |
| Ab29 | 3.788 | 0.0097 | 0.041 |
| Ab135 | 3.873 | 0.0254 | 0.0252 |
| Ab171 | 3.386 | 0.0346 | 0.0864 |
| Ab194 | 3.347 | 0.0259 | 0.0706 |
| Ab184 | 3.397 | 0.0143 | 0.0575 |
| Ab164 | 3.385 | 0.0154 | 0.2894 |
| Ab183 | 3.504 | 0.0057 | 0.1102 |
| Ab158 | 2.994 | >1 μM | 0.1565 |
| Ab55 | 3.749 | 1.023 | 0.2907 |
| Ab136 | 3.962 | 0.1768 | >1 μM |
| Ab39 | 3.736 | 0.0327 | 0.0803 |
| Ab159 | 3.076 | 0.3846 | 0.1161 |
| Ab151 | 3.308 | 0.3766 | 0.1758 |
| Ab139 | 3.959 | 0.1302 | 0.1246 |
| Ab107 | 3.845 | >1 μM | inconclusive |
| Ab36 | 3.713 | 0.0628 | 0.47 |
| Ab193 | 3.465 | 0.0046 | >1 μM |
| Ab115 | 3.936 | >1 μM | >1 μM |
| Ab106 | 3.94 | 0.2288 | 0.1248 |
| Ab138 | 3.743 | 0.234 | 0.0586 |
| Ab127 | 3.732 | >1 μM | >1 μM |
| Ab165 | 3.672 | 0.0128 | 0.2285 |
| Ab155 | 3.325 | 0.0328 | 0.234 |
| Ab19 | 3.703 | 0.0198 | 0.0648 |
| Ab6 | 3.698 | 0.0254 | >1 μM |
| Ab187 | 3.356 | 0.0062 | >1 μM |
| Ab179 | 3.418 | 0.155 | 0.228 |
| Ab65 | 3.709 | >1 μM | 0.778 |
| Ab114 | 4.018 | >1 μM | >1 μM |
| Ab102 | 3.927 | >1 μM | >1 μM |
| Ab94 | 4.036 | 0.0893 | 0.058 |
| Ab163 | 3.661 | 0.0492 | 0.3167 |
| Ab110 | 3.785 | 0.065 | 0.0619 |
| Ab80 | 3.885 | 0.8983 | 0.478 |
| Ab92 | 3.859 | | |
| Ab117 | 3.835 | 0.0017 | 0.0107 |
| Ab162 | 3.398 | 0.0018 | 0.0204 |
| Ab121 | 3.976 | >1 μM | >1 μM |
| Ab195 | 3.507 | 0.0441 | 0.1059 |
| Ab84 | 4.008 | 0.3919 | 0.2207 |
| Ab161 | 3.394 | 0.1222 | 0.4079 |
| Ab198 | 3.528 | 0.0214 | 0.0691 |
| Ab24 | 3.462 | 0.0359 | 0.2545 |
| Ab98 | 3.95 | 0.0366 | 0.0219 |
| Ab116 | 3.845 | 0.4443 | >1 μM |
| Ab174 | 3.723 | 0.0145 | 0.1727 |
| Ab196 | 3.654 | 0.0037 | 0.0195 |
| Ab51 | 3.03 | 0.0972 | 0.0798 |

TABLE 1.1-continued (ARE)

| clone | Goat anti-HuKappa | ELISA-Human TIGIT, 10 pt | ELISA-Mouse TIGIT, 10 pt |
|---|---|---|---|
| Ab91 | 3.977 | inconclusive | 0.242 |
| Ab185 | 3.343 | 0.0817 | 0.1013 |
| Ab23 | 3.719 | 0.289 | 0.0744 |
| Ab7 | 3.521 | 0.0146 | 0.0115 |
| Ab95 | 3.867 | 0.3572 | 0.1001 |
| Ab100 | 3.756 | inconclusive | 0.2575 |
| Ab140 | 3.776 | inconclusive | 0.1734 |
| Ab145 | 3.946 | 0.2325 | 0.0504 |
| Ab150 | 2.646 | >1 μM | 0.0007 |
| Ab168 | 3.143 | 0.4759 | 0.2526 |
| Ab54 | 3.744 | 0.0919 | 0.0215 |
| Ab77 | 3.792 | | 0.1114 |
| Ab43 | 3.195 | 0.0479 | 0.0172 |
| Ab160 | 3.134 | 0.4041 | 0.0264 |
| Ab82 | 3.882 | inconclusive | 0.0615 |
| Ab189 | 3.353 | 0.0364 | 0.0529 |
| Ab17 | 3.576 | 0.0147 | 0.014 |
| Ab103 | 3.926 | 5000 | inconclusive |
| Ab18 | 3.731 | 0.0453 | 0.049 |
| Ab130 | 3.844 | inconclusive | 0.432 |
| Ab132 | 3.799 | >1 μM | 0.3113 |
| Ab134 | 3.998 | >1 μM | 0.343 |
| Ab144 | 3.863 | >1 μM | 0.315 |

TABLE 1.2

(ARG)

| clone | Goat anti-HuKappa | ELISA-Human TIGIT, 10 pt | ELISA-Mouse TIGIT, 10 pt |
|---|---|---|---|
| Ab2 | 3.335 | 0.0157 | >1 μM |
| Ab47 | 3.058 | 0.0349 | 0.3614 |
| Ab49 | 3.297 | 0.0276 | 0.058 |
| Ab31 | 3.724 | 0.0125 | 0.0569 |
| Ab53 | 3.183 | 0.0043 | 0.0076 |
| Ab40 | 2.531 | 0.0003 | >1 μM |
| Ab5 | 3.59 | 0.0101 | 0.322 |
| Ab9 | 3.618 | 0.0326 | 0.1814 |
| Ab48 | 3.02 | 0.0138 | 0.0418 |
| Ab4 | 3.462 | 0.0012 | >1 μM |
| Ab10 | 3.547 | 0.1011 | 0.0407 |
| Ab37 | 3.819 | 0.0408 | 0.2208 |
| Ab33 | 3.716 | 0.025 | 0.0854 |
| Ab42 | 3.012 | 0.0765 | 0.0605 |
| Ab45 | 3.226 | 0.0354 | 0.048 |

TABLE 1.3

(ARV)

| clone | Goat anti-HuKappa | ELISA-Human TIGIT, 10 pt | ELISA-Mouse TIGIT, 10 pt |
|---|---|---|---|
| Ab44 | 3.253 | 0.0135 | 0.1281 |
| Ab97 | 3.763 | 0.2887 | >1 μM |
| Ab81 | 3.878 | 0.0495 | 0.3073 |
| Ab188 | 3.166 | 0.0093 | 0.0403 |
| Ab186 | 3.497 | 0.0207 | 0.429 |
| Ab62 | 3.665 | >1 μM | 0.3612 |
| Ab57 | 3.839 | 0.1454 | 0.3054 |
| Ab192 | 3.463 | 0.0124 | 0.2952 |
| Ab73 | 3.736 | >1 μM | 0.2659 |
| Ab60 | 3.778 | 0.0798 | inconclusive |
| Ab28 | 3.701 | 0.0075 | 0.0287 |
| Ab32 | 3.648 | 0.0043 | 0.0147 |
| Ab78 | 3.779 | 0.119 | >1 μM |

TABLE 1.3-continued (ARV)

| clone | Goat anti-HuKappa | ELISA-Human TIGIT, 10 pt | ELISA-Mouse TIGIT, 10 pt |
|---|---|---|---|
| Ab14 | 3.723 | 0.0201 | 0.1694 |
| Ab152 | 3.518 | 0.0271 | >1 μM |
| Ab72 | 3.853 | 0.0817 | 0.2347 |
| Ab137 | 3.973 | inconclusive | 0.0849 |
| Ab128 | 3.779 | inconclusive | 0.2646 |
| Ab169 | 3.491 | 0.1527 | 0.1099 |
| Ab87 | 3.783 | inconclusive | 0.2304 |
| Ab74 | 3.757 | 0.1768 | 0.0419 |
| Ab172 | 3.357 | 0.0832 | 0.1078 |
| Ab153 | 3.255 | 0.0877 | 0.0139 |
| Ab120 | 3.849 | >1 μM | 0.2542 |
| Ab13 | 3.51 | 0.0431 | 0.0592 |
| Ab113 | 3.941 | inconclusive | inconclusive |
| Ab16 | 3.609 | 0.0036 | 0.0049 |
| Ab56 | 3.687 | | 0.0196 |
| Ab129 | 3.847 | >1 μM | >1 μM |
| Ab50 | 3.191 | 0.0447 | 0.0178 |
| Ab90 | 3.897 | inconclusive | 0.2034 |
| Ab99 | 3.938 | 0.1757 | 0.05 |
| Ab3 | 3.422 | 0.0586 | >1 μM |
| Ab148 | 4.042 | 0.1681 | 0.0164 |
| Ab124 | 3.905 | 0.0343 | 0.0141 |
| Ab22 | 3.684 | 0.0091 | 0.0051 |
| Ab41 | 3.025 | 0.011 | 0.0095 |
| Ab119 | 3.981 | inconclusive | 0.2786 |
| Ab157 | 3.001 | 0.1654 | 0.1161 |
| Ab27 | 3.554 | 0.0127 | 0.0177 |
| Ab15 | 3.697 | 0.005 | 0.0084 |
| Ab191 | 3.448 | 0.0449 | 0.1044 |
| Ab190 | 3.543 | 0.0021 | 0.0234 |
| Ab79 | 3.88 | 0.0278 | 0.0866 |
| Ab181 | 3.258 | | |
| Ab146 | 3.967 | 0.0076 | 0.0078 |
| Ab167 | 3.475 | 0.0126 | 0.0612 |
| Ab88 | 3.986 | 0.149 | 0.4074 |
| Ab199 | 3.308 | 0.0018 | 0.081 |
| Ab71 | 3.738 | >1 μM | 0.477 |
| Ab85 | 4.014 | >1 μM | 0.6825 |
| Ab59 | 3.779 | >1 μM | >1 μM |
| Ab141 | 3.74 | 0.1766 | 0.1233 |
| Ab68 | 3.904 | 0.639 | >1 μM |
| Ab143 | 3.89 | 0.0034 | 0.0057 |
| Ab46 | 3.418 | 0.0082 | 0.095 |
| Ab197 | 3.462 | 0.0111 | 0.0814 |
| Ab175 | 3.684 | 0.0052 | 0.0393 |
| Ab156 | 3.312 | >1 μM | 0.1645 |
| Ab63 | 3.732 | 0.0919 | 0.1785 |
| Ab11 | 3.69 | 0.0902 | 0.3594 |
| Ab182 | 3.334 | 0.1813 | 0.1997 |
| Ab89 | 3.869 | inconclusive | inconclusive |
| Ab8 | 3.699 | 0.106 | 0.1493 |
| Ab101 | 3.89 | inconclusive | 0.535 |
| Ab25 | 3.504 | 0.0135 | 0.0209 |
| Ab154 | 3.347 | 0.0908 | 0.1218 |
| Ab21 | 3.699 | 0.202 | 0.1467 |
| Ab111 | 3.795 | inconclusive | 0.1855 |
| Ab118 | 3.989 | 0.392 | 0.1096 |
| Ab173 | 3.395 | 0.0457 | 0.0649 |
| Ab38 | 3.65 | 0.0455 | >1 μM |
| Ab76 | 3.949 | 0.0681 | 0.0657 |
| Ab131 | 3.917 | 0.0072 | 0.3313 |
| Ab1 | 4 | 0.0403 | 0.1807 |
| Ab67 | 3.791 | >1 μM | >1 μM |
| Ab70 | 3.896 | >1 μM | >1 μM |
| Ab170 | 3.581 | 0.1379 | >1 μM |
| Ab30 | 3.67 | 0.0157 | 0.1353 |
| Ab93 | 4.019 | 0.1221 | >1 μM |
| Ab142 | 3.836 | 0.1085 | >1 μM |
| Ab104 | 3.899 | >1 μM | >1 μM |
| Ab112 | 3.955 | 0.7522 | 0.2131 |
| Ab35 | 3.811 | 0.0312 | 0.3566 |
| Ab126 | 3.889 | 0.2034 | 0.0641 |
| Ab125 | 3.977 | 0.1273 | 0.1505 |

Example 2

Biochemical Competitive Binding

The ability of the antibodies to block polio virus receptor (PVR; aka CD155) binding to the human or the mouse TIGIT extra cellular domain (TIGIT-ECD) was assessed by ELISA. PVR was coated on 384-well Immunolon plates in coating buffer at 0.5 μg/mL. Antibodies were serially diluted in a 10-point curve starting at 1 μM in 3-fold steps. Human TIGIT proteins were biotinylated using the EZ-Link NHS-PEG4-biotin kit (Thermo Fisher). The antibodies were pre-incubated with biotinylated human TIGIT or mouse TIGIT-Fc at a concentration of 500 ng/mL in 1% BSA in PBST for 1 hour. The mixtures of antibodies and receptors were added to the PVR-coated plates for 1 hour. The inhibition of ligand-receptor interaction for the human TIGIT was detected with streptavidin-HRP at a concentration of 10 ng/mL and TMB. The inhibition of ligand-receptor interaction for the mouse TIGIT was detected by ELISA. Data from these binding assays is shown in Tables 2.1-2.3. Units are in microM.

TABLE 2.1

(ARE)

| clone | Competitive ELISA-Human TIGIT, 10 pt | Competitive ELISA-Mouse TIGIT, 10 pt |
|---|---|---|
| Ab58 | 0.1382 | 0.2384 |
| Ab69 | 0.9167 | >1 μM |
| Ab75 | 0.2715 | 1.857 |
| Ab133 | 1.254 | >1 μM |
| Ab177 | 0.1303 | 0.2831 |
| Ab122 | 0.7483 | >1 μM |
| Ab86 | 0.1243 | 0.3617 |
| Ab180 | 0.1276 | 0.1949 |
| Ab83 | inconclusive | 0.9737 |
| Ab26 | 0.2748 | 0.2356 |
| Ab20 | 0.1557 | 0.1801 |
| Ab147 | >1 μM | >1 μM |
| Ab12 | 0.0934 | >1 μM |
| Ab66 | 0.279 | 0.3091 |
| Ab176 | 0.1252 | 0.1697 |
| Ab96 | 0.1926 | 0.4967 |
| Ab123 | 0.2292 | 1.944 |
| Ab109 | 0.4441 | 1.305 |
| Ab149 | >1 μM | 0.0471 |
| Ab34 | 0.0552 | 0.5826 |
| Ab61 | 0.3977 | 0.8403 |
| Ab64 | 0.1249 | 0.3621 |
| Ab105 | 0.573 | 1.916 |
| Ab108 | 0.6936 | 2.819 |
| Ab178 | 0.04 | 0.0591 |
| Ab166 | 0.0226 | 0.028 |
| Ab29 | 0.0493 | 0.2798 |
| Ab135 | 0.1447 | 0.0865 |
| Ab171 | 0.1697 | 0.1323 |
| Ab194 | 0.155 | 0.2223 |
| Ab184 | 0.1058 | 0.1206 |
| Ab164 | 0.0753 | 0.1047 |
| Ab183 | 0.0751 | 0.1144 |
| Ab158 | >1 μM | 0.1315 |
| Ab55 | 0.255 | 0.3675 |
| Ab136 | >1 μM | 0.9557 |
| Ab39 | 0.1213 | 0.1891 |
| Ab159 | 0.5386 | 0.2718 |
| Ab151 | 0.4453 | 0.6308 |
| Ab139 | 0.249 | 2.148 |
| Ab107 | 5000 | 5000 |
| Ab36 | 0.1261 | 0.8038 |
| Ab193 | 0.093 | >1 μM |
| Ab115 | 0.6072 | >1 μM |

TABLE 2.1-continued (ARE)

| clone | Competitive ELISA-Human TIGIT, 10 pt | Competitive ELISA-Mouse TIGIT, 10 pt |
|---|---|---|
| Ab106 | 0.2179 | 0.1886 |
| Ab138 | 0.1772 | 0.252 |
| Ab127 | 0.8486 | 0.4914 |
| Ab165 | 0.0891 | 0.1888 |
| Ab155 | 0.203 | 0.5006 |
| Ab19 | 0.0735 | 0.1839 |
| Ab6 | 0.0639 | 0.5111 |
| Ab187 | 0.0817 | 0.1319 |
| Ab179 | 0.3039 | 0.3944 |
| Ab65 | 0.435 | 0.4874 |
| Ab114 | 0.4728 | >1 µM |
| Ab102 | 0.4836 | 0.7866 |
| Ab94 | 0.1157 | 0.0847 |
| Ab163 | 0.2119 | 0.1305 |
| Ab110 | 0.1659 | 0.1999 |
| Ab80 | 0.2575 | 0.2643 |
| Ab92 | | |
| Ab117 | 0.0385 | 0.0234 |
| Ab162 | 0.0433 | 0.0283 |
| Ab121 | 0.41 | 2.066 |
| Ab195 | 0.2459 | 0.301 |
| Ab84 | 0.1373 | 0.257 |
| Ab161 | 0.372 | 0.8733 |
| Ab198 | 0.1292 | 0.2535 |
| Ab24 | 0.1175 | 1.024 |
| Ab98 | 0.0447 | 0.0593 |
| Ab116 | 0.704 | >1 µM |
| Ab174 | 0.1075 | 0.085 |
| Ab196 | 0.0493 | 0.0452 |
| Ab51 | 0.0754 | 0.3106 |
| Ab91 | inconclusive | 0.4574 |
| Ab185 | 0.3398 | 0.1977 |
| Ab23 | 0.0931 | 0.1432 |
| Ab7 | 0.0598 | 0.0568 |
| Ab95 | 0.526 | 0.2019 |
| Ab100 | 5000 | inconclusive |
| Ab140 | 0.6338 | 0.4787 |
| Ab145 | 0.4258 | 0.3346 |
| Ab150 | >1 µM | 0.0046 |
| Ab168 | 0.8658 | 0.2572 |
| Ab54 | 0.1124 | 0.0729 |
| Ab77 | 0.5447 | 0.4125 |
| Ab43 | 0.1965 | 0.0608 |
| Ab160 | 0.4074 | 0.2125 |
| Ab82 | 0.5809 | 0.1076 |
| Ab189 | 0.1396 | 0.1408 |
| Ab17 | 0.0529 | 0.0458 |
| Ab103 | inconclusive | 1.114 |
| Ab18 | 0.1906 | 0.1878 |
| Ab130 | >1 µM | 5000 |
| Ab132 | >1 µM | 0.771 |
| Ab134 | >1 µM | 0.8851 |
| Ab144 | >1 µM | 1.09 |

TABLE 2.2

(ARG)

| clone | Competitive ELISA-Human TIGIT, 10 pt | Competitive ELISA-Mouse TIGIT, 10 pt |
|---|---|---|
| Ab2 | 0.038 | >1 µM |
| Ab47 | 0.4918 | 0.3799 |
| Ab49 | 0.158 | 0.2649 |
| Ab31 | 0.0502 | 0.2728 |
| Ab53 | 0.009 | 0.0353 |
| Ab40 | 0.0038 | >1 µM |
| Ab5 | 0.0357 | 0.3774 |

TABLE 2.2-continued (ARG)

| clone | Competitive ELISA-Human TIGIT, 10 pt | Competitive ELISA-Mouse TIGIT, 10 pt |
|---|---|---|
| Ab9 | 0.0911 | 1.005 |
| Ab48 | 0.1106 | 0.0647 |
| Ab4 | 0.0059 | >1 µM |
| Ab10 | 0.071 | 0.0688 |
| Ab37 | 0.1471 | 0.2166 |
| Ab33 | 0.0826 | 0.5685 |
| Ab42 | 0.1988 | 0.1124 |
| Ab45 | 0.1 | 0.1219 |

TABLE 2.3

(ARV)

| clone | Competitive ELISA-Human TIGIT, 10 pt | Competitive ELISA-Mouse TIGIT, 10 pt |
|---|---|---|
| Ab44 | 0.0416 | 0.2812 |
| Ab97 | 0.232 | 1.107 |
| Ab81 | 0.062 | 0.3523 |
| Ab188 | 0.0456 | 0.1 |
| Ab186 | 0.1016 | 0.885 |
| Ab62 | 0.2667 | 0.9408 |
| Ab57 | 0.0566 | 0.1306 |
| Ab192 | 0.1592 | 0.5436 |
| Ab73 | 0.0999 | 1.219 |
| Ab60 | 0.0464 | 0.2728 |
| Ab28 | 0.0248 | 0.1435 |
| Ab32 | 0.0134 | 0.0507 |
| Ab78 | 0.1277 | 1.836 |
| Ab14 | 0.059 | 0.8418 |
| Ab152 | 0.1067 | 1.095 |
| Ab72 | 0.4462 | 0.2266 |
| Ab137 | inconclusive | 0.2111 |
| Ab128 | inconclusive | 0.3249 |
| Ab169 | 0.4434 | 0.1726 |
| Ab87 | inconclusive | 0.3725 |
| Ab74 | 0.1058 | 0.0589 |
| Ab172 | 0.3863 | 0.1174 |
| Ab153 | 0.1494 | 0.0691 |
| Ab120 | 0.457 | 0.3177 |
| Ab13 | 0.1233 | 0.1482 |
| Ab113 | inconclusive | 1.026 |
| Ab16 | 0.0159 | 0.0258 |
| Ab56 | 0.0997 | 0.1266 |
| Ab129 | >1 µM | 0.1293 |
| Ab50 | 0.0397 | 0.0466 |
| Ab90 | 0.3526 | 0.2541 |
| Ab99 | 0.1653 | 0.0807 |
| Ab3 | 0.0235 | >1 µM |
| Ab148 | 0.1738 | 0.1201 |
| Ab124 | 0.2217 | 0.0856 |
| Ab22 | 0.018 | 0.0242 |
| Ab41 | 0.0764 | 0.0447 |
| Ab119 | inconclusive | 0.3888 |
| Ab157 | 0.4347 | 0.5118 |
| Ab27 | 0.047 | 0.0518 |
| Ab15 | 0.022 | 0.04 |
| Ab191 | 0.2782 | 0.2256 |
| Ab190 | 0.037 | 0.0432 |
| Ab79 | 0.0543 | 0.0334 |
| Ab181 | | |
| Ab146 | 0.0453 | 0.0361 |
| Ab167 | 0.0885 | 0.0682 |
| Ab88 | 0.6681 | 1.364 |
| Ab199 | 0.0464 | 0.1109 |
| Ab71 | 0.1221 | 0.5911 |
| Ab85 | 0.141 | 0.1534 |
| Ab59 | >1 µM | >1 µM |

TABLE 2.3-continued (ARV)

| clone | Competitive ELISA-Human TIGIT, 10 pt | Competitive ELISA-Mouse TIGIT, 10 pt |
|---|---|---|
| Ab141 | 0.215 | 0.2806 |
| Ab68 | 0.2926 | 0.5568 |
| Ab143 | 0.0203 | 0.022 |
| Ab46 | 0.1883 | 0.1185 |
| Ab197 | 0.1104 | 0.1045 |
| Ab175 | 0.042 | 0.0533 |
| Ab156 | >1 µM | 0.0653 |
| Ab63 | 0.2041 | 0.1838 |
| Ab11 | 0.1969 | 0.3391 |
| Ab182 | 0.5126 | 0.5807 |
| Ab89 | inconclusive | 0.9985 |
| Ab8 | 0.3472 | 0.4284 |
| Ab101 | inconclusive | 5000 |
| Ab25 | 0.047 | 0.0602 |
| Ab154 | 0.3326 | 0.2508 |
| Ab21 | 0.1282 | 0.3154 |
| Ab111 | 0.4407 | 0.7051 |
| Ab118 | 0.6052 | 0.3567 |
| Ab173 | 0.1468 | 0.1674 |
| Ab38 | 0.08 | >1 µM |
| Ab76 | 0.1274 | 0.0896 |
| Ab131 | 0.1713 | 0.116 |
| Ab1 | 0.0899 | 0.6317 |
| Ab67 | 0.6037 | 2.581 |
| Ab70 | 0.4496 | 1.891 |
| Ab170 | 0.4011 | 0.4345 |
| Ab30 | 0.084 | 0.3441 |
| Ab93 | 0.4337 | 0.9349 |
| Ab142 | 0.6591 | 2.169 |
| Ab104 | 2.364 | 1.555 |
| Ab112 | 0.293 | 0.3211 |
| Ab35 | 0.1199 | 0.4375 |
| Ab126 | 0.3398 | 0.1827 |
| Ab125 | 0.1111 | 1.395 |

Example 3

Inhibition of Grb2 Recruitment Assay (Competitive Binding)

YTS cells (NK cell line) were engineered to express human TIGIT fused to the Alpha portion of beta galactosidase (beta gal) and Grb2 fused to the complementary omega portion of beta gal (or vice versa) (YTS_TIGIT/Grb2). 721.221 cells (B-cell line) were engineered to express PVR (221_PVR). Binding of PRV with TIGIT increases recruitment of Grb2 to TIGIT in the YTS cells. YTS cells were plated and then incubated with serial dilutions of antibody for 1.5 hours at 37 degrees C. 221_PVR cells were then added to the YTS cells and co-cultured overnight (16-24 hours). The extent of TIGIT binding with Grb2 was detected using a chemiluminescence beta gal staining kit and read on a fluorescence plate reader to assess reconstitution of active beta gal enzyme. The ratio of Grb2-TIGIT binding in the absence and presence of antibody was calculated to determine IC50 of inhibition of Grb2 recruitment. Data from these inhibition assays is shown in Tables 3.1-3.4 and units are in microM.

TABLE 3.1

(ARE)

| clone | YTS_hTIGI/hGrbs_EFC_Antagonism, YTS_hTIGIT/hGrb2, 221_hPVR/ICAM, 11 pt |
|---|---|
| Ab58 | |
| Ab69 | |
| Ab75 | |
| Ab133 | |
| Ab177 | |
| Ab122 | |
| Ab86 | |
| Ab180 | |
| Ab83 | |
| Ab26 | |
| Ab20 | |
| Ab147 | |
| Ab12 | |
| Ab66 | |
| Ab176 | |
| Ab96 | |
| Ab123 | |
| Ab109 | |
| Ab149 | |
| Ab34 | |
| Ab61 | |
| Ab64 | |
| Ab105 | |
| Ab108 | |
| Ab178 | 0.3616 |
| Ab166 | 0.0212 |
| Ab29 | |
| Ab135 | |
| Ab171 | |
| Ab194 | |
| Ab184 | |
| Ab164 | |
| Ab183 | |
| Ab158 | |
| Ab55 | |
| Ab136 | |
| Ab39 | |
| Ab159 | |
| Ab151 | |
| Ab139 | |
| Ab107 | |
| Ab36 | |
| Ab193 | |
| Ab115 | |
| Ab106 | |
| Ab138 | |
| Ab127 | |
| Ab165 | |
| Ab155 | |
| Ab19 | |
| Ab6 | |
| Ab187 | |
| Ab179 | |
| Ab65 | |
| Ab114 | |
| Ab102 | |
| Ab94 | |
| Ab163 | |
| Ab110 | |
| Ab80 | |
| Ab92 | |
| Ab117 | |
| Ab162 | 0.3645 |
| Ab121 | |
| Ab195 | |
| Ab84 | |
| Ab161 | |
| Ab198 | |
| Ab24 | |
| Ab98 | |
| Ab116 | |
| Ab174 | |
| Ab196 | |
| Ab51 | |

TABLE 3.1-continued

(ARE)

| clone | YTS_hTIGI/hGrbs_EFC_Antagonism, YTS_hTIGIT/hGrb2, 221_hPVR/ICAM, 11 pt |
|---|---|
| Ab91 | |
| Ab185 | |
| Ab23 | |
| Ab7 | |
| Ab95 | |
| Ab100 | |
| Ab140 | |
| Ab145 | |
| Ab150 | |
| Ab168 | |
| Ab54 | |
| Ab77 | |
| Ab43 | |
| Ab160 | |
| Ab82 | |
| Ab189 | |
| Ab17 | |
| Ab103 | |
| Ab18 | |
| Ab130 | |
| Ab132 | |
| Ab134 | |
| Ab144 | |

TABLE 3.2

(ARG)

| clone | YTS_hTIGI/hGrbs_EFC_Antagonism, YTS_hTIGIT/hGrb2, 221_hPVR/ICAM, 11 pt |
|---|---|
| Ab2 | |
| Ab47 | |
| Ab49 | |
| Ab31 | |
| Ab53 | 0.0303 |
| Ab40 | 0.0023 |
| Ab5 | |
| Ab9 | |
| Ab48 | |
| Ab4 | 0.0922 |
| Ab10 | |
| Ab37 | |
| Ab33 | |
| Ab42 | |
| Ab45 | |

TABLE 3.3

(ARV)

| clone | YTS_hTIGI/hGrbs_EFC_Antagonism, YTS_hTIGIT/hGrb2, 221_hPVR/ICAM, 11 pt |
|---|---|
| Ab44 | |
| Ab97 | |
| Ab81 | |
| Ab188 | |
| Ab186 | |
| Ab62 | |
| Ab57 | |
| Ab192 | |
| Ab73 | |
| Ab60 | |
| Ab28 | 0.2034 |
| Ab32 | 1.407 |
| Ab78 | |

TABLE 3.3-continued

(ARV)

| clone | YTS_hTIGIT/hGrbs_EFC_Antagonism, YTS_hTIGIT/hGrb2, 221_hPVR/ICAM, 11 pt |
|---|---|
| Ab14 | |
| Ab152 | |
| Ab72 | |
| Ab137 | |
| Ab128 | |
| Ab169 | |
| Ab87 | |
| Ab74 | |
| Ab172 | |
| Ab153 | |
| Ab120 | |
| Ab13 | |
| Ab113 | |
| Ab16 | 1.744 |
| Ab56 | |
| Ab129 | |
| Ab50 | |
| Ab90 | |
| Ab99 | |
| Ab3 | 0.1131 |
| Ab148 | |
| Ab124 | |
| Ab22 | 0.6079 |
| Ab41 | |
| Ab119 | |
| Ab157 | |
| Ab27 | |
| Ab15 | |
| Ab191 | |
| Ab190 | |
| Ab79 | |
| Ab181 | |
| Ab146 | |
| Ab167 | |
| Ab88 | |
| Ab199 | |
| Ab71 | |
| Ab85 | |
| Ab59 | |
| Ab141 | |
| Ab68 | |
| Ab143 | 0.0602 |
| Ab46 | 0.1593 |
| Ab197 | |
| Ab175 | 0.2877 |
| Ab156 | |
| Ab63 | |
| Ab11 | |
| Ab182 | |
| Ab89 | |
| Ab8 | |
| Ab101 | |
| Ab25 | |
| Ab154 | |
| Ab21 | |
| Ab111 | |
| Ab118 | |
| Ab173 | |
| Ab38 | |
| Ab76 | |
| Ab131 | 0.065 |
| Ab1 | |
| Ab67 | |
| Ab70 | |
| Ab170 | |
| Ab30 | |
| Ab93 | |
| Ab142 | |
| Ab104 | |
| Ab112 | |
| Ab35 | |
| Ab126 | |
| Ab125 | |

Example 4

Cell-Based Binding Assay (Dimerization)

YTS cells were engineered to express both TIGIT fused to the alpha portion of a beta gal and TIGIT fused to the omega portion of a beta gal (YTS_TIGIT/TIGIT). YTS cells were plated and then incubated with serial dilutions of antibody for 1.5 hours at 37 degrees C. 221_PVR cells were then added to the YTS cells and co-cultured overnight (16-24 hours). The extent of TIGIT dimerization was detected using a chemiluminescence beta gal staining kit and read on a fluorescence plate reader to assess reconstitution of active beta gal enzyme. The ratio of TIGIT dimerization in the absence and presence of antibody was calculated to determine EC50 of induced dimerization. Data from these assays is shown in Tables 4.1-4.3 and units are in microM.

TABLE 4.1

| | (ARE) |
|---|---|
| clone | YTS_hTIGIT/hTIGIT_EFC, YTS_hTIGIT/hTIGIT, 11 pt |
| Ab58 | |
| Ab69 | |
| Ab75 | |
| Ab133 | |
| Ab177 | |
| Ab122 | |
| Ab86 | |
| Ab180 | |
| Ab83 | |
| Ab26 | |
| Ab20 | |
| Ab147 | |
| Ab12 | |
| Ab66 | |
| Ab176 | |
| Ab96 | 0.3209 |
| Ab123 | |
| Ab109 | |
| Ab149 | |
| Ab34 | |
| Ab61 | |
| Ab64 | 0.7377 |
| Ab105 | |
| Ab108 | |
| Ab178 | 0.0487 |
| Ab166 | 0.0147 |
| Ab29 | |
| Ab135 | |
| Ab171 | |
| Ab194 | |
| Ab184 | |
| Ab164 | |
| Ab183 | |
| Ab158 | |
| Ab55 | 0.2214 |
| Ab136 | |
| Ab39 | |
| Ab159 | |
| Ab151 | |
| Ab139 | |
| Ab107 | |
| Ab36 | |
| Ab193 | |
| Ab115 | |
| Ab106 | |
| Ab138 | |
| Ab127 | |
| Ab165 | |
| Ab155 | |
| Ab19 | |
| Ab6 | |
| Ab187 | |

TABLE 4.1-continued

| | (ARE) |
|---|---|
| clone | YTS_hTIGIT/hTIGIT_EFC, YTS_hTIGIT/hTIGIT, 11 pt |
| Ab179 | |
| Ab65 | |
| Ab114 | |
| Ab102 | |
| Ab94 | |
| Ab163 | |
| Ab110 | 0.3595 |
| Ab80 | |
| Ab92 | |
| Ab117 | |
| Ab162 | >1 μM |
| Ab121 | |
| Ab195 | |
| Ab84 | |
| Ab161 | |
| Ab198 | |
| Ab24 | |
| Ab98 | |
| Ab116 | |
| Ab174 | |
| Ab196 | |
| Ab51 | 0.0408 |
| Ab91 | |
| Ab185 | |
| Ab23 | |
| Ab7 | |
| Ab95 | |
| Ab100 | |
| Ab140 | |
| Ab145 | |
| Ab150 | |
| Ab168 | |
| Ab54 | |
| Ab77 | |
| Ab43 | |
| Ab160 | |
| Ab82 | |
| Ab189 | |
| Ab17 | |
| Ab103 | |
| Ab18 | |
| Ab130 | |
| Ab132 | |
| Ab134 | |
| Ab144 | |

TABLE 4.2

| | (ARG) |
|---|---|
| clone | YTS_hTIGIT/hTIGIT_EFC, YTS_hTIGIT/hTIGIT, 11 pt |
| Ab2 | |
| Ab47 | |
| Ab49 | |
| Ab31 | |
| Ab53 | 0.0027 |
| Ab40 | 0.0095 |
| Ab5 | |
| Ab9 | |
| Ab48 | 0.4772 |
| Ab4 | |
| Ab10 | 0.0572 |
| Ab37 | |
| Ab33 | |
| Ab42 | |
| Ab45 | |

TABLE 4.3

| clone | (ARV) YTS_hTIGIT/hTIGIT_EFC, YTS_hTIGIT/hTIGIT, 11 pt |
|---|---|
| Ab44 | |
| Ab97 | |
| Ab81 | |
| Ab188 | |
| Ab186 | |
| Ab62 | |
| Ab57 | 0.1528 |
| Ab192 | |
| Ab73 | |
| Ab60 | 0.404 |
| Ab28 | |
| Ab32 | |
| Ab78 | |
| Ab14 | |
| Ab152 | |
| Ab72 | |
| Ab137 | |
| Ab128 | |
| Ab169 | |
| Ab87 | |
| Ab74 | 0.0019 |
| Ab172 | |
| Ab153 | |
| Ab120 | |
| Ab13 | |
| Ab113 | |
| Ab16 | |
| Ab56 | |
| Ab129 | |
| Ab50 | |
| Ab90 | 0.0074 |
| Ab99 | 0.154 |
| Ab3 | |
| Ab148 | |
| Ab124 | 0.3928 |
| Ab22 | 0.0403 |
| Ab41 | |
| Ab119 | |
| Ab157 | |
| Ab27 | |
| Ab15 | |
| Ab191 | |
| Ab190 | |
| Ab79 | |
| Ab181 | |
| Ab146 | |
| Ab167 | |
| Ab88 | |
| Ab199 | |
| Ab71 | |
| Ab85 | |
| Ab59 | |
| Ab141 | |
| Ab68 | |
| Ab143 | 0.0047 |
| Ab46 | 0.0056 |
| Ab197 | |
| Ab175 | 0.0898 |
| Ab156 | |
| Ab63 | |
| Ab11 | |
| Ab182 | |
| Ab89 | |
| Ab8 | |
| Ab101 | |
| Ab25 | |
| Ab154 | |
| Ab21 | |
| Ab111 | |
| Ab118 | |
| Ab173 | |
| Ab38 | |
| Ab76 | |
| Ab131 | 0.0172 |
| Ab1 | |
| Ab67 | |
| Ab70 | |
| Ab170 | |
| Ab30 | |
| Ab93 | |
| Ab142 | |
| Ab104 | |
| Ab112 | |
| Ab35 | |
| Ab126 | 0.0375 |
| Ab125 | |

Example 5

Method of Identification of TIGIT Antibodies from Phage Display Screening

In order to generate the above antibodies, phage displayed human antibody libraries were composed of diversified monovalent Fabs displayed as pIII fusions on the surface of M13 bacteriophage. Monovalent Fabs comprise human heavy chain frameworks, including the CH1 region, diversified in CDRs 1, 2, and 3 and complexed with a defined set of human antibody light chains.

Phagemid expression of monovalent Fab libraries was accomplished by standard methods. TG-1 cells transformed with expression plasmids were grown to mid log (O.D. 600 .about.0.3) in 2-YT media supplemented with 100 mcg/ml ampicillin and 2% glucose repression and then infected with m13K07 helper phage and grown overnight in 2-YT media supplemented with 100 mcg ampicillin, 70 mcg/ml kanamycin, and 200 micromolar IPTG. Phage containing supernatants were precipitated using polyethylene glycol and PBS resuspended phage were used to pan on immobilized TIGIT.

Panning of the libraries was performed by using recombinant soluble extracellular domains of TIGIT (Sino Biologicssor R&D Systems) immobilized on the wells of a microtiter dish or biotinylated TIGIT immobilized on streptavidin derivatized magnetic beads (Dynal—Life Technologies).

In the plate-based format, Immulon 4HBX ELISA plates were coated with TIGIT. The TIGIT sequences used can be found in FIG. 4. Plates were then blocked in PBS, 0.05% Tween 20, 4% non-fat dried milk for 1 hour. Approximately $10^{12}$-$10^{13}$ phage were blocked as above and applied to the target coated wells. Following a two hour incubation, the wells were washed using PBS, 0.05% Tween 20. Phage were then eluted 0.2M Glycine-HCl, pH 2.2, 1 mg/ml BSA. Eluted phage were neutralized using 2M Tris base. The eluted phage were subjected to additional rounds of amplification and panning until the titer of the phage eluted from the TIGIT coated wells exceeded the titer eluted from uncoated, blocked wells.

In bead based panning, TIGIT was biotinylated using a NHS-PEO$_4$-biotinylation kit (Pierce). The biotinlyated protein was then immobilized on magnetic streptavidin beads (Dynal—Life Technologies). Panning was carried out essentially as described above for plate based panning except that PBS, 0.05% Tween 20, 1% BSA was used as the blocking agent. Beads were collected magnetically following the initial phage binding and after each wash step.

To identify phage clones that encoded TIGIT-binding monovalent Fabs, a portion of the eluted phage were used to infect *E. coli* HB2151 allowing expression of periplasmic phage-encoded monovalent Fabs. Individual clones were picked into deep-well plates and grown overnight in 2YT containing ampicillin and 0.2 mM IPTG. Bacteria were lysed in BPERII and the lysates were applied to TIGIT coated plates. Following washing, binding of antibodies was detected using an HRP-conjugated anti-human kappa and lambda light chain antibody (Bethyl). Daughter plates were also inoculated and grown in 2YT-Amp-glucose for Sanger-based sequencing to determine the antibody heavy and light chain sequences.

Example 6

Presented in Table 6.1 are the results noted above, as well as the results for IgGs made using the corresponding CDRs sequences for the noted constructs from Example 5. Table 6.1 also provides data showing antagonism of the receptor in an assay that uses the same Grb2/TIGIT beta gal set up as provided in the above example 3, but the value provided is an EC50 value of Grb2 binding increase by the antibody in an assay replacing the 221_PVR cells with wild-type 221 cells (cells that don't express PVR). The point changes noted in the fourth column represent variants. Where no point change is present, then the IgG contained the same sequence as noted in the sequence for the designated antibody number.

TABLE 6.1

| Ab | Name of IgG | IgG used | Point changes within CDRs | ELISA - Human TIGIT, 10 pt | ELISA - Mouse TIGIT, 10 pt | Comp. ELISA - Human TIGIT, 10 pt | Comp. ELISA - Mouse TIGIT, 10 pt | YTS_hTIGI/hGrbs_EFC_Agonism, YTS_hTIGI/hGrb2, 221_WT, 11 pt | YTS_hTIGI/hGrbs_EFC_Antagonism, YTS_hTIGIT/hGrb2, 221_hPVR/ICAM, 11 pt | YTS_hTIGIT/hTIGIT_EFC, YTS_hTIGIT/hTIGIT, 11 pt | YTS_hTIGIT/hTIGIT_EFC, YTS_hTIGIT/hTIGIT, 221_hPVR/ICAM, 11 pt |
|---|---|---|---|---|---|---|---|---|---|---|---|
| Ab1 | | | | 0.0403 | 0.1807 | 0.0899 | 0.6317 | | | | |
| | Ab1i1 | hIgG1 | | | | | | 0.0091 | >1 μM | 0.0007 | |
| | Ab1i2 | mIgG2a | | | | | | | | | |
| | Ab1i3 | hIgG1s | | | | | | >1 μM | 0.1725 | 0.0024 | |
| | Ab1i4 | hIgG1s | I100aM | | | | | | | | |
| | Ab1i5 | mIgG2a | I100aA | 0.0008 | 0.0068 | 0.0028 | 0.0133 | | | | |
| | Ab1i6 | mIgG2a | P96A | 0.0294 | >1 μM | 0.0469 | >1 μM | | | | |
| | Ab1i7 | mIgG2a | S98A | 0.0038 | 0.0729 | 0.0161 | 0.1832 | | | | |
| | Ab1i8 | mIgG2a | S98G | 0.0017 | 0.0263 | 0.0058 | 0.0993 | | | | |
| | Ab1i9 | mIgG2a | V95A | 0.0006 | 0.0023 | 0.0023 | 0.009 | | | | |
| | Ab1i10 | mIgG2a | V99A | 0.0039 | 0.0151 | 0.0058 | 0.4876 | | | | |
| | Ab1i11 | mIgG2a | W100A | >1 μM | >1 μM | >1 μM | >1 μM | | | | |
| | Ab1i12 | mIgG2a | Y97A | >1 μM | >1 μM | >1 μM | >1 μM | | | | |
| Ab2 | | | | 0.0157 | >1 μM | 0.038 | >1 μM | | | | |
| | Ab2i1 | hIgG1s | | | | | | | | | |
| Ab3 | | | | 0.0586 | >1 μM | 0.0235 | >1 μM | 0.0441 | 0.1131 | | 0.058 |
| | Ab3i1 | hIgG1 | | 0.002 | >1 μM | 0.0013 | >1 μM | 4999 | 0.3842 | 0.0026 | |
| Ab4 | | | | 0.0012 | >1 μM | 0.0059 | >1 μM | >1 μM | 0.0922 | inconclusive | 0.0784 |
| | Ab4i1 | hIgG1 | | 0.0003 | >1 μM | 0.0014 | >1 μM | inconclusive | 0.0131 | 0.0038 | >1 μM |
| Ab5 | | | | 0.0101 | 0.322 | 0.0357 | 0.3774 | | | | |
| Ab6 | | | | 0.0254 | >1 μM | 0.0639 | 0.5111 | | | | |
| Ab7 | | | | 0.0146 | 0.0115 | 0.0598 | 0.0568 | | | | |
| Ab8 | | | | 0.106 | 0.1493 | 0.3472 | 0.4284 | | | | |
| Ab9 | | | | 0.0326 | 0.1814 | 0.0911 | 1.005 | | | | |
| Ab10 | | | | 0.1011 | 0.0407 | 0.071 | 0.0688 | >1 μM | >1 μM | 0.0572 | |
| | Ab10i1 | mIgG2a | | 0.0003 | 0.0001 | 0.0056 | 0.0012 | >1 μM | inconclusive | inconclusive | |
| | Ab10i2 | hIgG1 | | 0.0003 | 0.0001 | 0.0085 | 0.0011 | inconclusive | 0.3896 | 0.0026 | |
| Ab11 | | | | 0.0902 | 0.3594 | 0.1969 | 0.3391 | | | | |
| Ab12 | | | | 0.0277 | >1 μM | 0.0934 | >1 μM | | | | |
| Ab13 | | | | 0.0431 | 0.0592 | 0.1233 | 0.1482 | | | | |
| Ab14 | | | | 0.0201 | 0.1694 | 0.059 | 0.8418 | | | | |
| Ab15 | | | | 0.005 | 0.0084 | 0.022 | 0.04 | >1 μM | >1 μM | >1 μM | |
| | Ab15i1 | hIgG1 | | 0.0048 | 0.0023 | 0.0022 | 0.0012 | >1 μM | >1 μM | 0.003 | |
| | Ab15i2 | mIgG2a | | 0.0216 | 0.0027 | 0.0109 | 0.0016 | >1 μM | 0.2749 | 0.0117 | |
| Ab16 | | | | 0.0036 | 0.0049 | 0.0159 | 0.0258 | inconclusive | 1.744 | inconclusive | |
| | Ab16i1 | hIgG1 | | 0.0021 | 0.0005 | 0.0021 | 0.0004 | inconclusive | inconclusive | 0.0036 | |
| | Ab16i2 | mIgG2a | | 0.0064 | 0.0005 | 0.0846 | 0.0041 | inconclusive | inconclusive | 0.008 | >1 μM |

TABLE 6.1-continued

| Ab | Name of IgG | IgG used | Point changes within CDRs | ELISA - Human TIGIT, 10 pt | ELISA - Mouse TIGIT, 10 pt | Comp. ELISA - Human TIGIT, 10 pt | Comp. ELISA - Mouse TIGIT, 10 pt | YTS_hTIGI/hGrbs_EFC_Agonism, YTS_hTIGIT/hGrb2, 221_WT, 11 pt | YTS_hTIGI/hGrbs_EFC_Antagonism, YTS_hTIGIT/hGrb2, 221_hPVR/ICAM, 11 pt | YTS_hTIGIT/hTIGIT_EFC, YTS_hTIGIT/hTIGIT, 11 pt | YTS_hTIGIT/hTIGIT_EFC, YTS_hTIGIT, 221_hPVR/ICAM, 11 pt |
|---|---|---|---|---|---|---|---|---|---|---|---|
| Ab17 | | | | 0.0147 | 0.014 | 0.0529 | 0.0458 | >1 µM | >1 µM | inconclusive | |
| | Ab17i1 | hIgG1 | | 0.0005 | 0.0001 | 0.0106 | 0.0011 | 0.0012 | >1 µM | 0.0022 | |
| | Ab17i2 | mIgG2a | | 0.0017 | 0.0002 | 0.0458 | 0.0016 | inconclusive | >1 µM | 0.0064 | |
| Ab18 | | | | 0.0453 | 0.049 | 0.1906 | 0.1878 | | | | |
| Ab19 | | | | 0.0198 | 0.0648 | 0.0735 | 0.1839 | | | | |
| Ab20 | | | | 0.033 | 0.0327 | 0.1557 | 0.1801 | | | | |
| Ab21 | | | | 0.202 | 0.1467 | 0.1282 | 0.3154 | | | | |
| | Ab21i1 | hIgG1 | | >1 µM | >1 µM | 0.0485 | 0.2616 | >1 µM | >1 µM | >1 µM | |
| | Ab21i2 | mIgG2a | | 0.0101 | 0.0101 | 0.0159 | 0.148 | inconclusive | inconclusive | 0.2593 | |
| Ab22 | | | | 0.0091 | 0.0051 | 0.018 | 0.0242 | 0.0155 | 0.6079 | 0.0403 | 0.1466 |
| | Ab22i1 | hIgG1 | | 0.0007 | 0.0003 | 0.0015 | 0.0005 | inconclusive | 0.1599 | 0.0025 | |
| | Ab22i2 | mIgG2a | | 0.0018 | 0.0002 | 0.0383 | 0.0026 | >1 µM | >1 µM | >1 µM | |
| Ab23 | | | | 0.289 | 0.0744 | 0.0931 | 0.1432 | | | | |
| Ab24 | | | | 0.0359 | 0.2545 | 0.1175 | 1.024 | | | | |
| Ab25 | | | | 0.0135 | 0.0209 | 0.047 | 0.0602 | | | | |
| Ab26 | | | | 0.0533 | 0.0475 | 0.2748 | 0.2356 | | | | |
| Ab27 | | | | 0.0127 | 0.0177 | 0.047 | 0.0518 | | | | |
| Ab28 | | | | 0.0075 | 0.0287 | 0.0248 | 0.1435 | inconclusive | 0.2034 | inconclusive | |
| | Ab28i1 | hIgG1 | | 0.0004 | 0.0027 | 0.0012 | 0.0013 | inconclusive | 0.0758 | 0.0009 | |
| | Ab28i2 | mIgG2a | | 0.0006 | 0.0025 | 0.002 | 0.0015 | inconclusive | 0.2601 | 0.0046 | |
| Ab29 | | | | 0.0097 | 0.041 | 0.0493 | 0.2798 | >1 µM | >1 µM | >1 µM | |
| | Ab29i1 | hIgG1 | | 0.0021 | 0.0135 | 0.0021 | 0.0035 | inconclusive | 0.3299 | 0.0028 | |
| | Ab29i2 | mIgG2a | | 0.0035 | 0.0139 | 0.0034 | 0.0084 | inconclusive | >1 µM | 0.3133 | >1 µM |
| Ab30 | | | | 0.0157 | 0.1353 | 0.084 | 0.3441 | | | | |
| Ab31 | | | | 0.0125 | 0.0569 | 0.0502 | 0.2728 | | | | |
| Ab32 | | | | 0.0043 | 0.0147 | 0.0134 | 0.0507 | inconclusive | 1.407 | >1 µM | |
| | Ab32i1 | hIgG1 | | 0.0004 | 0.0025 | 0.0011 | 0.0014 | inconclusive | 0.069 | 0.0024 | |
| | Ab32i2 | mIgG2a | | 0.0005 | 0.0021 | 0.002 | 0.0015 | inconclusive | 0.2425 | 0.003 | |
| Ab33 | | | | 0.025 | 0.0854 | 0.0826 | 0.5685 | | | | |
| Ab34 | | | | 0.0087 | 0.105 | 0.0552 | 0.5826 | | | | |
| | Ab34i1 | hIgG1 | | 0.056 | >1 µM | 0.0038 | 0.0275 | >1 µM | 0.4964 | 0.0136 | |
| | Ab34i2 | mIgG2a | | 0.0242 | >1 µM | 0.013 | 0.0859 | >1 µM | >1 µM | 0.0276 | |
| Ab35 | | | | 0.0312 | 0.3566 | 0.1199 | 0.4375 | | | | |
| Ab36 | | | | 0.0628 | 0.47 | 0.1261 | 0.8038 | | | | |
| Ab37 | | | | 0.0408 | 0.2208 | 0.1471 | 0.2166 | | | | |
| Ab38 | | | | 0.0455 | >1 µM | 0.08 | >1 µM | | | | |
| Ab39 | | | | 0.0327 | 0.0803 | 0.1213 | 0.1891 | | | | |
| Ab40 | | | | 0.0003 | >1 µM | 0.0038 | >1 µM | >1 µM | 0.0023 | 0.0095 | |
| | Ab40i1 | hIgG1 | | 0.0003 | >1 µM | 0.0013 | >1 µM | >1 µM | 0.0002 | 0.0018 | |
| | Ab40i2 | hIgG1 | G33S | 0.0002 | >1 µM | 0.002 | >1 µM | 0.0011 | 0.1858 | 0.0037 | |
| | Ab40i3 | mIgG2a | G33S | 0.0002 | 0.041 | 0.0037 | >1 µM | 0.08 | 0.0098 | 0.0016 | |
| | Ab40i4 | hIgG1 | G33S_Y52aS | 0.0003 | 0.0025 | 0.003 | 0.0111 | 0.0007 | 1.629 | 0.0032 | |
| | Ab40i5 | mIgG2a | G33S_Y52aS | 0.0002 | 0.0024 | 0.0042 | 0.0169 | 0.0358 | 0.2382 | 0.0031 | |
| | Ab40i6 | hIgG1 | Y52aS | 0.0003 | 0.037 | 0.0027 | 0.0788 | 0.0014 | 0.2762 | 0.0032 | |
| | Ab40i7 | mIgG2a | Y52aS | 0.0002 | 0.0076 | 0.003 | 0.1207 | 0.0156 | 0.0163 | 0.0027 | |
| Ab41 | | | | 0.011 | 0.0095 | 0.0764 | 0.0447 | >1 µM | >1 µM | | |
| | Ab41i1 | hIgG1 | | 0.0004 | 0.0002 | 0.0013 | 0.001 | >1 µM | >1 µM | 0.0018 | |
| | Ab41i2 | mIgG2a | | 0.0051 | 0.0003 | 0.0026 | 0.0019 | >1 µM | >1 µM | 0.0081 | |
| Ab42 | | | | 0.0765 | 0.0605 | 0.1988 | 0.1124 | | | | |
| Ab43 | | | | 0.0479 | 0.0172 | 0.1965 | 0.0608 | | | | |
| Ab44 | | | | 0.0135 | 0.1281 | 0.0416 | 0.2812 | | | | |
| Ab45 | | | | 0.0354 | 0.048 | 0.1 | 0.1219 | | | | |

TABLE 6.1-continued

| Ab | Name of IgG | IgG used | Point changes within CDRs | ELISA - Human TIGIT, 10 pt | ELISA - Mouse TIGIT, 10 pt | Comp. ELISA - Human TIGIT, 10 pt | Comp. ELISA - Mouse TIGIT, 10 pt | YTS_ hTIGI/ hGrbs_ EFC_ Agonism, YTS_ hTIGIT/ hGrb2, 221_WT, 11 pt | YTS_ hTIGI/ hGrbs_ EFC_ Antagonism, YTS_ hTIGIT/ hGrb2, 221_ hPVR/ ICAM, 11 pt | YTS_ hTIGIT/ hTIGIT_ EFC, YTS_ hTIGIT/ hTIGIT, 11 pt | YTS_ hTIGIT/ hTIGIT_ EFC, YTS_ hTIGIT, 221_ hPVR/ ICAM, 11 pt |
|---|---|---|---|---|---|---|---|---|---|---|---|
| Ab46 | | | | 0.0082 | 0.095 | 0.1883 | 0.1185 | 5000 | 0.1593 | 0.0056 | |
| | Ab46i1 | hIgG1 | | 0.0002 | 0.005 | 0.0011 | 0.0211 | inconclusive | 0.0773 | 0.0005 | |
| | Ab46i2 | mIgG2a | | 0.0006 | 0.0058 | 0.0019 | 0.3671 | inconclusive | 0.8703 | 0.0013 | |
| Ab47 | | | | 0.0349 | 0.3614 | 0.4918 | 0.3799 | | | | |
| Ab48 | | | | 0.0138 | 0.0418 | 0.1106 | 0.0647 | inconclusive | inconclusive | 0.4772 | |
| | Ab48i1 | hIgG1 | | 0.0002 | 0.0002 | 0.0019 | 0.0015 | 2499 | 0.0286 | 0.0013 | |
| | Ab48i2 | mIgG2a | | 0.0002 | 0.0002 | 0.0016 | 0.0019 | 1999 | 0.0068 | 0.0012 | |
| Ab49 | | | | 0.0276 | 0.058 | 0.158 | 0.2649 | | | | |
| Ab50 | | | | 0.0447 | 0.0178 | 0.0397 | 0.0466 | >1 μM | >1 μM | >1 μM | |
| | Ab50i1 | mIgG2a | | 0.0028 | 0.0003 | 0.0653 | 0.0021 | >1 μM | inconclusive | 0.0063 | |
| | Ab50i2 | hIgG1 | | 0.0003 | 0.0002 | 0.0066 | 0.0015 | 0.0032 | inconclusive | 0.0017 | |
| Ab51 | | | | 0.0972 | 0.0798 | 0.0754 | 0.3106 | >1 μM | inconclusive | 0.0408 | |
| Ab52 | | | | | | | | | | | |
| | Ab52i1 | hIgG1 | | 0.0002 | 0.0004 | 0.0025 | 0.0041 | 0.0011 | 0.1899 | 0.0045 | |
| Ab53 | | | | 0.0043 | 0.0076 | 0.009 | 0.0353 | inconclusive | 0.0303 | 0.0027 | |
| | Ab53i1 | mIgG2a | | 0.0003 | 0.0004 | 0.0016 | 0.0042 | 1999 | 0.0259 | 0.0016 | 0.0012 |
| | Ab53i2 | hIgG1 | | 0.0001 | 0.0002 | 0.0006 | 0.0015 | inconclusive | 0.0675 | 0.0011 | |
| | Ab53i3 | hIgG1 | S33G | 0.0008 | 0.0063 | 0.0083 | 0.0185 | 0.0042 | >1 μM | 0.0046 | |
| | Ab53i4 | mIgG2a | S33G | 0.0011 | 0.0046 | 0.0067 | 0.0482 | 0.0185 | 0.4499 | 0.0035 | |
| | Ab53i5 | hIgG1aY | S33G_S52 | 0.0002 | >1 μM | 0.0021 | >1 μM | 0.0057 | 0.526 | 0.0023 | |
| | Ab53i6 | mIgG2a | S33G_S52aY | 0.0002 | 0.0323 | 0.0017 | >1 μM | 0.0077 | 0.0363 | 0.0016 | |
| | Ab53i7 | hIgG1 | S52aY | 0.0032 | >1 μM | 0.0363 | 0.061 | 0.0681 | 1.928 | 0.0061 | |
| | Ab53i8 | mIgG2a | S52aY | 0.0017 | 0.034 | 0.0125 | >1 μM | 0.02 | >1 μM | 0.0029 | |
| Ab54 | | | | 0.0919 | 0.0215 | 0.1124 | 0.0729 | | | | |
| Ab55 | | | | 1.023 | 0.2907 | 0.255 | 0.3675 | >1 μM | >1 μM | 0.2214 | |
| Ab56 | | | | | 0.0196 | 0.0997 | 0.1266 | | | | |
| Ab57 | | | | 0.1454 | 0.3054 | 0.0566 | 0.1306 | >1 μM | >1 μM | 0.1528 | |
| Ab58 | | | | 0.6869 | 0.1695 | 0.1382 | 0.2384 | | | | |
| Ab59 | | | | >1 μM | >1 μM | >1 μM | >1 μM | | | | |
| Ab60 | | | | 0.0798 | inconclusive | 0.0464 | 0.2728 | >1 μM | >1 μM | 0.404 | |
| Ab61 | | | | 0.1125 | >1 μM | 0.3977 | 0.8403 | | | | |
| Ab62 | | | | >1 μM | 0.3612 | 0.2667 | 0.9408 | | | | |
| Ab63 | | | | 0.0919 | 0.1785 | 0.2041 | 0.1838 | >1 μM | >1 μM | >1 μM | |
| Ab64 | | | | 0.229 | inconclusive | 0.1249 | 0.3621 | >1 μM | >1 μM | 0.7377 | |
| Ab65 | | | | >1 μM | 0.778 | 0.435 | 0.4874 | | | | |
| Ab66 | | | | 0.2596 | >1 μM | 0.279 | 0.3091 | | | | |
| Ab67 | | | | >1 μM | >1 μM | 0.6037 | 2.581 | | | | |
| Ab68 | | | | 0.639 | >1 μM | 0.2926 | 0.5568 | | | | |
| Ab69 | | | | >1 μM | >1 μM | 0.9167 | >1 μM | | | | |
| Ab70 | | | | >1 μM | >1 μM | 0.4496 | 1.891 | | | | |
| Ab71 | | | | >1 μM | 0.477 | 0.1221 | 0.5911 | | | | |
| Ab72 | | | | 0.0817 | 0.2347 | 0.4462 | 0.2266 | >1 μM | >1 μM | >1 μM | |
| Ab73 | | | | >1 μM | 0.2659 | 0.0999 | 1.219 | | | | |
| Ab74 | | | | 0.1768 | 0.0419 | 0.1058 | 0.0589 | 0.0008 | >1 μM | 0.0019 | |
| Ab75 | | | | >1 μM | >1 μM | 0.2715 | 1.857 | | | | |
| Ab76 | | | | 0.0681 | 0.0657 | 0.1274 | 0.0896 | 0.0504 | >1 μM | >1 μM | |
| Ab77 | | | | | 0.1114 | 0.5447 | 0.4125 | >1 μM | >1 μM | >1 μM | |
| Ab78 | | | | 0.119 | >1 μM | 0.1277 | 1.836 | | | | |
| Ab79 | | | | 0.0278 | 0.0866 | 0.0543 | 0.0334 | >1 μM | >1 μM | >1 μM | |
| Ab80 | | | | 0.8983 | 0.478 | 0.2575 | 0.2643 | >1 μM | >1 μM | >1 μM | |
| Ab81 | | | | 0.0495 | 0.3073 | 0.062 | 0.3523 | | | | |
| Ab82 | | | | inconclusive | 0.0615 | 0.5809 | 0.1076 | >1 μM | >1 μM | >1 μM | |
| Ab83 | | | | inconclusive | inconclusive | inconclusive | 0.9737 | | | | |

TABLE 6.1-continued

| Ab | Name of IgG | IgG used | Point changes within CDRs | ELISA - Human TIGIT, 10 pt | ELISA - Mouse TIGIT, 10 pt | Comp. ELISA - Human TIGIT, 10 pt | Comp. ELISA - Mouse TIGIT, 10 pt | YTS_ hTIGI/ hGrbs_ EFC_ Agonism, YTS_ hTIGIT/ hGrb2, 221_WT, 11 pt | YTS_ hTIGI/ hGrbs_ EFC_ Antagonism, YTS_ hTIGIT/ hGrb2, 221_ hPVR/ ICAM, 11 pt | YTS_ hTIGIT/ hTIGIT_ EFC, YTS_ hTIGIT/ hTIGIT, 11 pt | YTS_ hTIGIT/ hTIGIT_ EFC, YTS_ hTIGIT, 221_ hPVR/ ICAM, 11 pt |
|---|---|---|---|---|---|---|---|---|---|---|---|
| Ab84 | | | | 0.3919 | 0.2207 | 0.1373 | 0.257 | >1 μM | >1 μM | >1 μM | |
| Ab85 | | | | >1 μM | 0.6825 | 0.141 | 0.1534 | | | | |
| Ab86 | | | | 0.2643 | 0.0838 | 0.1243 | 0.3617 | | | | |
| Ab87 | | | | inconclusive | 0.2304 | inconclusive | 0.3725 | >1 μM | >1 μM | >1 μM | |
| Ab88 | | | | 0.149 | 0.4074 | 0.6681 | 1.364 | | | | |
| Ab89 | | | | inconclusive | inconclusive | inconclusive | 0.9985 | | | | |
| Ab90 | | | | inconclusive | 0.2034 | 0.3526 | 0.2541 | 0.0153 | >1 μM | 0.0074 | |
| Ab91 | | | | inconclusive | 0.242 | inconclusive | 0.4574 | | | | |
| Ab92 | | | | | | | | | | | |
| Ab93 | | | | 0.1221 | >1 μM | 0.4337 | 0.9349 | | | | |
| Ab94 | | | | 0.0893 | 0.058 | 0.1157 | 0.0847 | 0.004 | >1 μM | >1 μM | |
| Ab95 | | | | 0.3572 | 0.1001 | 0.526 | 0.2019 | >1 μM | >1 μM | >1 μM | |
| Ab96 | | | | 0.2106 | 0.3444 | 0.1926 | 0.4967 | >1 μM | >1 μM | 0.3209 | |
| Ab97 | | | | 0.2887 | >1 μM | 0.232 | 1.107 | | | | |
| Ab98 | | | | 0.0366 | 0.0219 | 0.0447 | 0.0593 | | | | |
| Ab99 | | | | 0.1757 | 0.05 | 0.1653 | 0.0807 | >1 μM | >1 μM | 0.154 | |
| Ab100 | | | | inconclusive | 0.2575 | 5000 | inconclusive | | | | |
| Ab101 | | | | inconclusive | 0.535 | inconclusive | 5000 | >1 μM | >1 μM | >1 μM | |
| Ab102 | | | | >1 μM | >1 μM | 0.4836 | 0.7866 | | | | |
| Ab103 | | | | 5000 | inconclusive | inconclusive | 1.114 | | | | |
| Ab104 | | | | >1 μM | >1 μM | 2.364 | 1.555 | | | | |
| Ab105 | | | | >1 μM | >1 μM | 0.573 | 1.916 | | | | |
| Ab106 | | | | 0.2288 | 0.1248 | 0.2179 | 0.1886 | >1 μM | >1 μM | >1 μM | |
| Ab107 | | | | >1 μM | inconclusive | 5000 | 5000 | | | | |
| Ab108 | | | | 0.8345 | 0.6831 | 0.6936 | 2.819 | | | | |
| Ab109 | | | | >1 μM | >1 μM | 0.4441 | 1.305 | | | | |
| Ab110 | | | | 0.065 | 0.0619 | 0.1659 | 0.1999 | >1 μM | >1 μM | 0.3595 | |
| Ab111 | | | | inconclusive | 0.1855 | 0.4407 | 0.7051 | | | | |
| Ab112 | | | | 0.7522 | 0.2131 | 0.293 | 0.3211 | >1 μM | >1 μM | >1 μM | |
| Ab113 | | | | inconclusive | inconclusive | inconclusive | 1.026 | | | | |
| Ab114 | | | | >1 μM | >1 μM | 0.4728 | >1 μM | | | | |
| Ab115 | | | | >1 μM | >1 μM | 0.6072 | >1 μM | | | | |
| Ab116 | | | | 0.4443 | >1 μM | 0.704 | >1 μM | | | | |
| Ab117 | | | | 0.0017 | 0.0107 | 0.0385 | 0.0234 | >1 μM | >1 μM | >1 μM | |
| Ab118 | | | | 0.392 | 0.1096 | 0.6052 | 0.3567 | >1 μM | >1 μM | >1 μM | |
| Ab119 | | | | inconclusive | 0.2786 | inconclusive | 0.3888 | >1 μM | >1 μM | >1 μM | |
| Ab120 | | | | >1 μM | 0.2542 | 0.457 | 0.3177 | | | | |
| Ab121 | | | | >1 μM | >1 μM | 0.41 | 2.066 | | | | |
| Ab122 | | | | 0.1347 | >1 μM | 0.7483 | >1 μM | | | | |
| Ab123 | | | | 0.43 | 0.5777 | 0.2292 | 1.944 | | | | |
| Ab124 | | | | 0.0343 | 0.0141 | 0.2217 | 0.0856 | >1 μM | >1 μM | 0.3928 | |
| Ab125 | | | | 0.1273 | 0.1505 | 0.1111 | 1.395 | | | | |
| Ab126 | | | | 0.2034 | 0.0641 | 0.3398 | 0.1827 | 0.0258 | >1 μM | 0.0375 | |
| Ab127 | | | | >1 μM | >1 μM | 0.8486 | 0.4914 | | | | |
| Ab128 | | | | inconclusive | 0.2646 | inconclusive | 0.3249 | >1 μM | >1 μM | >1 μM | |
| Ab129 | | | | >1 μM | >1 μM | >1 μM | 0.1293 | | | | |
| Ab130 | | | | inconclusive | 0.432 | >1 μM | 5000 | >1 μM | >1 μM | >1 μM | |
| Ab131 | | | | 0.0072 | 0.3313 | 0.1713 | 0.116 | >1 μM | 0.065 | 0.0172 | |
| Ab132 | | | | >1 μM | 0.3113 | >1 μM | 0.771 | | | | |
| Ab133 | | | | >1 μM | >1 μM | 1.254 | >1 μM | | | | |
| Ab134 | | | | >1 μM | 0.343 | >1 μM | 0.8851 | | | | |
| Ab135 | | | | 0.0254 | 0.0252 | 0.1447 | 0.0865 | >1 μM | >1 μM | >1 μM | |
| Ab136 | | | | 0.1768 | >1 μM | >1 μM | 0.9557 | | | | |

TABLE 6.1-continued

| Ab | Name of IgG | IgG used | Point changes within CDRs | ELISA - Human TIGIT, 10 pt | ELISA - Mouse TIGIT, 10 pt | Comp. ELISA - Human TIGIT, 10 pt | Comp. ELISA - Mouse TIGIT, 10 pt | YTS_ hTIGI/ hGrbs_ EFC_ Agonism, YTS_ hTIGIT/ hGrb2, 221_WT, 11 pt | YTS_ hTIGI/ hGrbs_ EFC_ Antagonism, YTS_ hTIGIT/ hGrb2, 221_ hPVR/ ICAM, 11 pt | YTS_ hTIGIT/ hTIGIT_ EFC, YTS_ hTIGIT/ hTIGIT, 11 pt | YTS_ hTIGIT/ hTIGIT_ EFC, YTS_ hTIGIT, 221_ hPVR/ ICAM, 11 pt |
|---|---|---|---|---|---|---|---|---|---|---|---|
| Ab137 | | | | inconclusive | 0.0849 | inconclusive | 0.2111 | | | | |
| Ab138 | | | | 0.234 | 0.0586 | 0.1772 | 0.252 | | | | |
| Ab139 | | | | 0.1302 | 0.1246 | 0.249 | 2.148 | | | | |
| Ab140 | | | | inconclusive | 0.1734 | 0.6338 | 0.4787 | | | | |
| Ab141 | | | | 0.1766 | 0.1233 | 0.215 | 0.2806 | | | | |
| Ab142 | | | | 0.1085 | >1 µM | 0.6591 | 2.169 | | | | |
| Ab143 | | | | 0.0034 | 0.0057 | 0.0203 | 0.022 | >1 µM | 0.0602 | | 0.0047 |
| Ab144 | | | | >1 µM | 0.315 | >1 µM | 1.09 | | | | |
| Ab145 | | | | 0.2325 | 0.0504 | 0.4258 | 0.3346 | | | | |
| Ab146 | | | | 0.0076 | 0.0078 | 0.0453 | 0.0361 | >1 µM | >1 µM | | >1 µM |
| Ab147 | | | | >1 µM | >1 µM | >1 µM | >1 µM | | | | |
| Ab148 | | | | 0.1681 | 0.0164 | 0.1738 | 0.1201 | | | | |
| Ab149 | | | | >1 µM | 0.052 | >1 µM | 0.0471 | | | | |
| Ab150 | | | | >1 µM | 0.0007 | >1 µM | 0.0046 | | | | |
| Ab151 | | | | 0.3766 | 0.1758 | 0.4453 | 0.6308 | | | | |
| Ab152 | | | | 0.0271 | >1 µM | 0.1067 | 1.095 | | | | |
| Ab153 | | | | 0.0877 | 0.0139 | 0.1494 | 0.0691 | | | | |
| Ab154 | | | | 0.0908 | 0.1218 | 0.3326 | 0.2508 | | | | |
| Ab155 | | | | 0.0328 | 0.234 | 0.203 | 0.5006 | | | | |
| Ab156 | | | | >1 µM | 0.1645 | >1 µM | 0.0653 | | | | |
| Ab157 | | | | 0.1654 | 0.1161 | 0.4347 | 0.5118 | | | | |
| Ab158 | | | | >1 µM | 0.1565 | >1 µM | 0.1315 | | | | |
| Ab159 | | | | 0.3846 | 0.1161 | 0.5386 | 0.2718 | | | | |
| Ab160 | | | | 0.4041 | 0.0264 | 0.4074 | 0.2125 | | | | |
| Ab161 | | | | 0.1222 | 0.4079 | 0.372 | 0.8733 | | | | |
| Ab162 | | | | 0.0018 | 0.0204 | 0.0433 | 0.0283 | >1 µM | 0.3645 | | >1 µM |
| Ab163 | | | | 0.0492 | 0.3167 | 0.2119 | 0.1305 | | | | |
| Ab164 | | | | 0.0154 | 0.2894 | 0.0753 | 0.1047 | | | | |
| Ab165 | | | | 0.0128 | 0.2285 | 0.0891 | 0.1888 | | | | |
| Ab166 | | | | 0.0041 | 0.0104 | 0.0226 | 0.028 | >1 µM | 0.0212 | | 0.0147 |
| Ab167 | | | | 0.0126 | 0.0612 | 0.0885 | 0.0682 | | | | |
| Ab168 | | | | 0.4759 | 0.2526 | 0.8658 | 0.2572 | | | | |
| Ab169 | | | | 0.1527 | 0.1099 | 0.4434 | 0.1726 | | | | |
| Ab170 | | | | 0.1379 | >1 µM | 0.4011 | 0.4345 | | | | |
| Ab171 | | | | 0.0346 | 0.0864 | 0.1697 | 0.1323 | | | | |
| Ab172 | | | | 0.0832 | 0.1078 | 0.3863 | 0.1174 | | | | |
| Ab173 | | | | 0.0457 | 0.0649 | 0.1468 | 0.1674 | | | | |
| Ab174 | | | | 0.0145 | 0.1727 | 0.1075 | 0.085 | | | | |
| Ab175 | | | | 0.0052 | 0.0393 | 0.042 | 0.0533 | >1 µM | 0.2877 | | 0.0898 |
| Ab176 | | | | 0.0206 | 0.1871 | 0.1252 | 0.1697 | | | | |
| Ab177 | | | | 0.0283 | 0.4387 | 0.1303 | 0.2831 | | | | |
| Ab178 | | | | 0.0061 | 0.024 | 0.04 | 0.0591 | >1 µM | 0.3616 | | 0.0487 |
| Ab179 | | | | 0.155 | 0.228 | 0.3039 | 0.3944 | | | | |
| Ab180 | | | | 0.0223 | 0.0784 | 0.1276 | 0.1949 | | | | |
| Ab181 | | | | | | | | | | | |
| Ab182 | | | | 0.1813 | 0.1997 | 0.5126 | 0.5807 | | | | |
| Ab183 | | | | 0.0057 | 0.1102 | 0.0751 | 0.1144 | | | | |
| Ab184 | | | | 0.0143 | 0.0575 | 0.1058 | 0.1206 | | | | |
| Ab185 | | | | 0.0817 | 0.1013 | 0.3398 | 0.1977 | | | | |
| Ab186 | | | | 0.0207 | 0.429 | 0.1016 | 0.885 | | | | |
| Ab187 | | | | 0.0062 | >1 µM | 0.0817 | 0.1319 | | | | |
| Ab188 | | | | 0.0093 | 0.0403 | 0.0456 | 0.1 | | | | |
| Ab189 | | | | 0.0364 | 0.0529 | 0.1396 | 0.1408 | | | | |
| Ab190 | | | | 0.0021 | 0.0234 | 0.037 | 0.0432 | | | | |
| Ab191 | | | | 0.0449 | 0.1044 | 0.2782 | 0.2256 | | | | |
| Ab192 | | | | 0.0124 | 0.2952 | 0.1592 | 0.5436 | | | | |
| Ab193 | | | | 0.0046 | >1 µM | 0.093 | >1 µM | | | | |
| Ab194 | | | | 0.0259 | 0.0706 | 0.155 | 0.2223 | | | | |
| Ab195 | | | | 0.0441 | 0.1059 | 0.2459 | 0.301 | | | | |
| Ab196 | | | | 0.0037 | 0.0195 | 0.0493 | 0.0452 | | | | |
| Ab197 | | | | 0.0111 | 0.0814 | 0.1104 | 0.1045 | | | | |
| Ab198 | | | | 0.0214 | 0.0691 | 0.1292 | 0.2535 | | | | |
| Ab199 | | | | 0.0018 | 0.081 | 0.0464 | 0.1109 | | | | |

In some embodiments, any one or more of the alternative CDRs provided as designated in column 4 of table 6.1 can be used for any of the antigen binding molecules or methods related thereto as provided herein. In some embodiments, any one or more of the IgG constructs provided in Table 6.1 can be employed as a construct, therapeutic, within a conjugate and/or in a method of treatment.

In some embodiments, an isolated antigen binding molecule (such as a full length antibody or antigen binding fragment thereof) can comprise any one or more of a CDR within any of SEQ ID NO. 1-SEQ ID NO: 97, SEQ ID NO: 195-SEQ ID NO: 209, SEQ ID NO: 225-SEQ ID NO: 310, SEQ ID NO: 98-SEQ ID NO: 194, SEQ ID NO: 210-SEQ ID NO: 224, or SEQ ID NO: 311-SEQ ID NO: 396 as shown in FIGS. 2A, 2B, 2C, 2D, 2E, 2F, 2G, 2H, 2I, 2J, 2K, 2L, 2M, 2N, 2O, 2P, 2Q, 2R, 3A, 3B, 3C, 3D, 3E, 3F, 3G, 3H, 3I, 3J, 3K, or 3L. In some embodiments, an isolated antigen binding molecule that competes for binding to human TIGIT with an antibody comprises all 6 CDRs from a single clone in any one of SEQ ID NO. 1-SEQ ID NO: 97, SEQ ID NO: 195-SEQ ID NO: 209, SEQ ID NO: 225-SEQ ID NO: 310, SEQ ID NO: 98-SEQ ID NO: 194, SEQ ID NO: 210-SEQ ID NO: 224, or SEQ ID NO: 311-SEQ ID NO: 396 as shown in FIGS. 2A, 2B, 2C, 2D, 2E, 2F, 2G, 2H, 2I, 2J, 2K, 2L, 2M, 2N, 2O, 2P, 2Q, 2R, 3A, 3B, 3C, 3D, 3E, 3F, 3G, 3H, 3I, 3J, 3K, or 3L. In some embodiments, an antigen binding molecule that competes with one of the above constructs can instead be employed.

In some embodiments, an isolated antigen binding molecule that competes for binding to human TIGIT with an antibody comprises a heavy variable region (SEQ ID NO. 1-SEQ ID NO: 97, SEQ ID NO: 195-SEQ ID NO: 209, SEQ ID NO: 225-SEQ ID NO: 310) and a light chain variable region (SEQ ID NO: 98-SEQ ID NO: 194, SEQ ID NO: 210-SEQ ID NO: 224, or SEQ ID NO: 311-SEQ ID NO: 396) from a single clone identified in any one of FIGS. 2A, 2B, 2C, 2D, 2E, 2F, 2G, 2H, 2I, 2J, 2K, 2L, 2M, 2N, 2O, 2P, 2Q or 2R.

In some embodiments, an isolated antigen binding molecule that binds to human TIGIT comprises a heavy chain CDR1 comprising the amino acid sequence of any one of the HCDR1s in SEQ ID NO: 397, SEQ ID NO: 403. SEQ ID NO: 409, SEQ ID NO: 415, SEQ ID NO: 421, SEQ ID NO: 427, SEQ ID NO: 433, SEQ ID NO: 439, SEQ ID NO: 445, SEQ ID NO: 451, SEQ ID NO: 457, SEQ ID NO: 463, SEQ ID NO: 469, SEQ ID NO: 475, SEQ ID NO: 481, SEQ ID NO: 487, SEQ ID NO: 493, SEQ ID NO: 499, SEQ ID NO: 505, SEQ ID NO: 511, SEQ ID NO: 517, SEQ ID NO: 523, SEQ ID NO: 529, SEQ ID NO: 535, SEQ ID NO: 541, SEQ ID NO: 547, SEQ ID NO: 553, SEQ ID NO: 559, SEQ ID NO: 565, SEQ ID NO: 571, SEQ ID NO: 577, SEQ ID NO: 583, SEQ ID NO: 589, SEQ ID NO: 595, SEQ ID NO: 601, SEQ ID NO: 607, SEQ ID NO: 613, SEQ ID NO: 619, SEQ ID NO: 625, SEQ ID NO: 631, SEQ ID NO: 637, SEQ ID NO: 643, SEQ ID NO: 649, SEQ ID NO: 655, SEQ ID NO: 661, SEQ ID NO: 667, SEQ ID NO: 673, SEQ ID NO: 679, SEQ ID NO: 685, SEQ ID NO: 691, SEQ ID NO: 697, SEQ ID NO: 703, SEQ ID NO: 709, SEQ ID NO: 715, SEQ ID NO: 721, SEQ ID NO: 727, SEQ ID NO: 733, SEQ ID NO: 739, SEQ ID NO: 745, SEQ ID NO: 751, SEQ ID NO: 757, SEQ ID NO: 763, SEQ ID NO: 769, SEQ ID NO: 775, SEQ ID NO: 781, SEQ ID NO: 787, SEQ ID NO: 793, SEQ ID NO: 799, SEQ ID NO: 805, SEQ ID NO: 811, SEQ ID NO: 817, SEQ ID NO: 823, SEQ ID NO: 829, SEQ ID NO: 835, SEQ ID NO: 841, SEQ ID NO: 847, SEQ ID NO: 853, SEQ ID NO: 859, SEQ ID NO: 865, SEQ ID NO: 871, SEQ ID NO: 877, SEQ ID NO: 883, SEQ ID NO: 889, SEQ ID NO: 895, SEQ ID NO: 901, SEQ ID NO: 907, SEQ ID NO: 913, SEQ ID NO: 919, SEQ ID NO: 925, SEQ ID NO: 931, SEQ ID NO: 937, SEQ ID NO: 943, SEQ ID NO: 949, SEQ ID NO: 955, SEQ ID NO: 961, SEQ ID NO: 967, SEQ ID NO: 973, SEQ ID NO: 979, SEQ ID NO: 985, SEQ ID NO: 991, SEQ ID NO: 997, SEQ ID NO: 1003, SEQ ID NO: 1009, SEQ ID NO: 1015, SEQ ID NO: 1021, SEQ ID NO: 1027, SEQ ID NO: 1033, SEQ ID NO: 1039, SEQ ID NO: 1045, SEQ ID NO: 1051, SEQ ID NO: 1057, SEQ ID NO: 1063, SEQ ID NO: 1069, SEQ ID NO: 1075, SEQ ID NO: 1081, SEQ ID NO: 1087, SEQ ID NO: 1093, SEQ ID NO: 1099, SEQ ID NO: 1105, SEQ ID NO: 1111, SEQ ID NO: 1117, SEQ ID NO: 1123, SEQ ID NO: 1129, SEQ ID NO: 1135, SEQ ID NO: 1141, SEQ ID NO: 1147, SEQ ID NO: 1153, SEQ ID NO: 1159, SEQ ID NO: 1165, SEQ ID NO: 1171, SEQ ID NO: 1177, SEQ ID NO: 1183, SEQ ID NO: 1189, SEQ ID NO: 1195, SEQ ID NO: 1201, SEQ ID NO: 1207, SEQ ID NO: 1213, SEQ ID NO: 1219, SEQ ID NO: 1225, SEQ ID NO: 1231, SEQ ID NO: 1237, SEQ ID NO: 1243, SEQ ID NO: 1249, SEQ ID NO: 1255, SEQ ID NO: 1261, SEQ ID NO: 1267, SEQ ID NO: 1273, SEQ ID NO: 1279, SEQ ID NO: 1285, SEQ ID NO: 1291, SEQ ID NO: 1297, SEQ ID NO: 1303, SEQ ID NO: 1309, SEQ ID NO: 1315, SEQ ID NO: 1321, SEQ ID NO: 1327, SEQ ID NO: 1333, SEQ ID NO: 1339, SEQ ID NO: 1345, SEQ ID NO: 1351, SEQ ID NO: 1357, SEQ ID NO: 1363, SEQ ID NO: 1369, SEQ ID NO: 1375, SEQ ID NO: 1381, SEQ ID NO: 1387, SEQ ID NO: 1393, SEQ ID NO: 1399, SEQ ID NO: 1405, SEQ ID NO: 1411, SEQ ID NO: 1417, SEQ ID NO: 1423, SEQ ID NO: 1429, SEQ ID NO: 1435, SEQ ID NO: 1441, SEQ ID NO: 1447, SEQ ID NO: 1453, SEQ ID NO: 1459, SEQ ID NO: 1465, SEQ ID NO: 1471, SEQ ID NO: 1477, SEQ ID NO: 1483, SEQ ID NO: 1489, SEQ ID NO: 1495, SEQ ID NO: 1501, SEQ ID NO: 1507, SEQ ID NO: 1513, SEQ ID NO: 1519, SEQ ID NO: 1593, SEQ ID NO: 1525 SEQ ID NO: 1531, SEQ ID NO: 1537, SEQ ID NO: 1543, SEQ ID NO: 1549, SEQ ID NO: 1555, SEQ ID NO: 1561, SEQ ID NO: 1567, SEQ ID NO: 1573, SEQ ID NO: 1579, or SEQ ID NO: 1585 as shown in FIGS. 3A, 3B, 3C, 3D, 3E, 3F, 3G, 3H, 3I, 3J, 3K, or 3L, a heavy chain CDR2 comprising the amino acid sequence of any one of the HCDR2s in SEQ ID NO: 398, SEQ ID NO: 404, SEQ ID NO: 410, SEQ ID NO: 416, SEQ ID NO: 422, SEQ ID NO: 428, SEQ ID NO: 434, SEQ ID NO: 440, SEQ ID NO: 446, SEQ ID NO: 452, SEQ ID NO: 458, SEQ ID NO: 464, SEQ ID NO: 470, SEQ ID NO: 476, SEQ ID NO: 482, SEQ ID NO: 488, SEQ ID NO: 494, SEQ ID NO: 500, SEQ ID NO: 506, SEQ ID NO: 512, SEQ ID NO: 518, SEQ ID NO: 524, SEQ ID NO: 530, SEQ ID NO: 536, SEQ ID NO: 542, SEQ ID NO: 548, SEQ ID NO: 554, SEQ ID NO: 560, SEQ ID NO: 566, SEQ ID NO: 572, SEQ ID NO: 578, SEQ ID NO: 584, SEQ ID NO: 590, SEQ ID NO: 596, SEQ ID NO: 602, SEQ ID NO: 608, SEQ ID NO: 614, SEQ ID NO: 620, SEQ ID NO: 626, SEQ ID NO: 632, SEQ ID NO: 638, SEQ ID NO: 644, SEQ ID NO: 650, SEQ ID NO: 656, SEQ ID NO: 662, SEQ ID NO: 668, SEQ ID NO: 674, SEQ ID NO: 680, SEQ ID NO: 686, SEQ ID NO: 692, SEQ ID NO: 698, SEQ ID NO: 704, SEQ ID NO: 710, SEQ ID NO: 716, SEQ ID NO: 722, SEQ ID NO: 728, SEQ ID NO: 734, SEQ ID NO: 740, SEQ ID NO: 746, SEQ ID NO: 752, SEQ ID NO: 758, SEQ ID NO: 764, SEQ ID NO: 770, SEQ ID NO: 776, SEQ ID NO: 782, SEQ ID NO: 788, SEQ ID NO: 794, SEQ ID NO: 800, SEQ ID NO: 806, SEQ ID NO: 812, SEQ ID NO: 818, SEQ ID NO: 824, SEQ ID NO: 830, SEQ ID NO: 836, SEQ ID NO: 842, SEQ ID NO: 848, SEQ ID NO: 854, SEQ ID NO: 860, SEQ ID NO: 866, SEQ ID NO: 872, SEQ ID NO: 878, SEQ ID NO: 884, SEQ ID NO: 890, SEQ ID NO:

896, SEQ ID NO: 902, SEQ ID NO: 908, SEQ ID NO: 914, SEQ ID NO: 920, SEQ ID NO: 926, SEQ ID NO: 932, SEQ ID NO: 938, SEQ ID NO: 944, SEQ ID NO: 950, SEQ ID NO: 956, SEQ ID NO: 962, SEQ ID NO: 968, SEQ ID NO: 974, SEQ ID NO: 980, SEQ ID NO: 986, SEQ ID NO: 992, SEQ ID NO: 998, SEQ ID NO: 1004, SEQ ID NO: 1010, SEQ ID NO: 1016, SEQ ID NO: 1022, SEQ ID NO: 1028, SEQ ID NO: 1034, SEQ ID NO: 1040, SEQ ID NO: 1046, SEQ ID NO: 1052, SEQ ID NO: 1058, SEQ ID NO: 1064, SEQ ID NO: 1070, SEQ ID NO: 1076, SEQ ID NO: 1082, SEQ ID NO: 1088, SEQ ID NO: 1094, SEQ ID NO: 1100, SEQ ID NO: 1106, SEQ ID NO: 1112, SEQ ID NO: 1118, SEQ ID NO: 1124, SEQ ID NO: 1130, SEQ ID NO: 1136, SEQ ID NO: 1142, SEQ ID NO: 1148, SEQ ID NO: 1154, SEQ ID NO: 1160, SEQ ID NO: 1166, SEQ ID NO: 1172, SEQ ID NO: 1178, SEQ ID NO: 1184, SEQ ID NO: 1190, SEQ ID NO: 1196, SEQ ID NO: 1202, SEQ ID NO: 1208, SEQ ID NO: 1214, SEQ ID NO: 1220, SEQ ID NO: 1226, SEQ ID NO: 1232, SEQ ID NO: 1238, SEQ ID NO: 1244, SEQ ID NO: 1250, SEQ ID NO: 1256, SEQ ID NO: 1262, SEQ ID NO: 1268, SEQ ID NO: 1274, SEQ ID NO: 1280, SEQ ID NO: 1286, SEQ ID NO: 1292, SEQ ID NO: 1298, SEQ ID NO: 1304, SEQ ID NO: 1310, SEQ ID NO: 1316, SEQ ID NO: 1322, SEQ ID NO: 1328, SEQ ID NO: 1334, SEQ ID NO: 1340, SEQ ID NO: 1346, SEQ ID NO: 1352, SEQ ID NO: 1358, SEQ ID NO: 1364, SEQ ID NO: 1370, SEQ ID NO: 1376, SEQ ID NO: 1382, SEQ ID NO: 1388, SEQ ID NO: 1394, SEQ ID NO: 1400, SEQ ID NO: 1406, SEQ ID NO: 1412, SEQ ID NO: 1418, SEQ ID NO: 1424, SEQ ID NO: 1430, SEQ ID NO: 1436, SEQ ID NO: 1442, SEQ ID NO: 1448, SEQ ID NO: 1454, SEQ ID NO: 1460, SEQ ID NO: 1466, SEQ ID NO: 1472, SEQ ID NO: 1478, SEQ ID NO: 1484, SEQ ID NO: 1490, SEQ ID NO: 1496, SEQ ID NO: 1502, SEQ ID NO: 1508, SEQ ID NO: 1514, SEQ ID NO: 1520, SEQ ID NO: 1594, SEQ ID NO: 1526, SEQ ID NO: 1532, SEQ ID NO: 1538, SEQ ID NO: 1544, SEQ ID NO: 1550, SEQ ID NO: 1556, SEQ ID NO: 1562, SEQ ID NO: 1568, SEQ ID NO: 1574, SEQ ID NO: 1580, or SEQ ID NO: 1586 as shown in FIGS. 3A, 3B, 3C, 3D, 3E, 3F, 3G, 3H, 3I, 3J, 3K, or 3L, and a heavy chain CDR3 comprising the amino acid sequence of any one of the HCDR3s in SEQ ID NO: 399, SEQ ID NO: 405, SEQ ID NO: 411, SEQ ID NO: 417, SEQ ID NO: 423, SEQ ID NO: 429, SEQ ID NO: 435, SEQ ID NO: 441, SEQ ID NO: 447, SEQ ID NO: 453, SEQ ID NO: 459, SEQ ID NO: 465, SEQ ID NO: 471, SEQ ID NO: 477, SEQ ID NO: 483, SEQ ID NO: 489, SEQ ID NO: 495, SEQ ID NO: 501, SEQ ID NO: 507, SEQ ID NO: 513, SEQ ID NO: 519, SEQ ID NO: 525, SEQ ID NO: 531, SEQ ID NO: 537, SEQ ID NO: 543, SEQ ID NO: 549, SEQ ID NO: 555, SEQ ID NO: 561, SEQ ID NO: 567, SEQ ID NO: 573, SEQ ID NO: 579, SEQ ID NO: 585, SEQ ID NO: 591, SEQ ID NO: 597, SEQ ID NO: 603, SEQ ID NO: 609, SEQ ID NO: 615, SEQ ID NO: 621, SEQ ID NO: 627, SEQ ID NO: 633, SEQ ID NO: 639, SEQ ID NO: 645, SEQ ID NO: 651, SEQ ID NO: 657, SEQ ID NO: 663, SEQ ID NO: 669, SEQ ID NO: 675, SEQ ID NO: 681, SEQ ID NO: 687, SEQ ID NO: 693, SEQ ID NO: 699, SEQ ID NO: 705, SEQ ID NO: 711, SEQ ID NO: 717, SEQ ID NO: 723, SEQ ID NO: 729, SEQ ID NO: 735, SEQ ID NO: 741, SEQ ID NO: 747, SEQ ID NO: 753, SEQ ID NO: 759, SEQ ID NO: 765, SEQ ID NO: 771, SEQ ID NO: 777, SEQ ID NO: 783, SEQ ID NO: 789, SEQ ID NO: 795, SEQ ID NO: 801, SEQ ID NO: 807, SEQ ID NO: 813, SEQ ID NO: 819, SEQ ID NO: 825, SEQ ID NO: 831, SEQ ID NO: 837, SEQ ID NO: 843, SEQ ID NO: 849, SEQ ID NO: 855, SEQ ID NO: 861, SEQ ID NO: 867, SEQ ID NO: 873, SEQ ID NO: 879, SEQ ID NO: 885, SEQ ID NO: 891, SEQ ID NO: 897, SEQ ID NO: 903, SEQ ID NO: 909, SEQ ID NO: 915, SEQ ID NO: 921, SEQ ID NO: 927, SEQ ID NO: 933, SEQ ID NO: 939, SEQ ID NO: 945, SEQ ID NO: 951, SEQ ID NO: 957, SEQ ID NO: 963, SEQ ID NO: 969, SEQ ID NO: 975, SEQ ID NO: 981, SEQ ID NO: 987, SEQ ID NO: 993, SEQ ID NO: 999, SEQ ID NO: 1005, SEQ ID NO: 1011, SEQ ID NO: 1017, SEQ ID NO: 1023, SEQ ID NO: 1029, SEQ ID NO: 1035, SEQ ID NO: 1041, SEQ ID NO: 1047, SEQ ID NO: 1053, SEQ ID NO: 1059, SEQ ID NO: 1065, SEQ ID NO: 1071, SEQ ID NO: 1077, SEQ ID NO: 1083, SEQ ID NO: 1089, SEQ ID NO: 1095, SEQ ID NO: 1101, SEQ ID NO: 1107, SEQ ID NO: 1113, SEQ ID NO: 1119, SEQ ID NO: 1125, SEQ ID NO: 1131, SEQ ID NO: 1137, SEQ ID NO: 1143, SEQ ID NO: 1149, SEQ ID NO: 1155, SEQ ID NO: 1161, SEQ ID NO: 1167, SEQ ID NO: 1173, SEQ ID NO: 1179, SEQ ID NO: 1185, SEQ ID NO: 1191, SEQ ID NO: 1197, SEQ ID NO: 1203, SEQ ID NO: 1209, SEQ ID NO: 1215, SEQ ID NO: 1221, SEQ ID NO: 1227, SEQ ID NO: 1233, SEQ ID NO: 1239, SEQ ID NO: 1245, SEQ ID NO: 1251, SEQ ID NO: 1257, SEQ ID NO: 1263, SEQ ID NO: 1269, SEQ ID NO: 1275, SEQ ID NO: 1281, SEQ ID NO: 1287, SEQ ID NO: 1293, SEQ ID NO: 1299, SEQ ID NO: 1305, SEQ ID NO: 1311, SEQ ID NO: 1317, SEQ ID NO: 1323, SEQ ID NO: 1329, SEQ ID NO: 1335, SEQ ID NO: 1341, SEQ ID NO: 1347, SEQ ID NO: 1353, SEQ ID NO: 1359, SEQ ID NO: 1365, SEQ ID NO: 1371, SEQ ID NO: 1377, SEQ ID NO: 1383, SEQ ID NO: 1389, SEQ ID NO: 1395, SEQ ID NO: 1401, SEQ ID NO: 1407, SEQ ID NO: 1413, SEQ ID NO: 1419, SEQ ID NO: 1425, SEQ ID NO: 1431, SEQ ID NO: 1437, SEQ ID NO: 1443, SEQ ID NO: 1449, SEQ ID NO: 1455, SEQ ID NO: 1461, SEQ ID NO: 1467, SEQ ID NO: 1473, SEQ ID NO: 1479, SEQ ID NO: 1485, SEQ ID NO: 1491, SEQ ID NO: 1497, SEQ ID NO: 1503, SEQ ID NO: 1509, SEQ ID NO: 1515, SEQ ID NO: 1521, SEQ ID NO: 1595, SEQ ID NO: 1527, SEQ ID NO: 1533, SEQ ID NO: 1539, SEQ ID NO: 1545, SEQ ID NO: 1551, SEQ ID NO: 1557, SEQ ID NO: 1563, SEQ ID NO: 1569, SEQ ID NO: 1575, SEQ ID NO: 1581, or SEQ ID NO: 1587 as shown in FIGS. 3A, 3B, 3C, 3D, 3E, 3F, 3G, 3H, 3I, 3J, 3K, or 3L.

In some embodiments, an isolated antigen binding molecule that binds to human TIGIT comprises a heavy chain CDR1 comprising the amino acid sequence of any one of the HCDR1s in SEQ ID NO: 397, SEQ ID NO: 403. SEQ ID NO: 409, SEQ ID NO: 415, SEQ ID NO: 421, SEQ ID NO: 427, SEQ ID NO: 433, SEQ ID NO: 439, SEQ ID NO: 445, SEQ ID NO: 451, SEQ ID NO: 457, SEQ ID NO: 463, SEQ ID NO: 469, SEQ ID NO: 475, SEQ ID NO: 481, SEQ ID NO: 487, SEQ ID NO: 493, SEQ ID NO: 499, SEQ ID NO: 505, SEQ ID NO: 511, SEQ ID NO: 517, SEQ ID NO: 523, SEQ ID NO: 529, SEQ ID NO: 535, SEQ ID NO: 541, SEQ ID NO: 547, SEQ ID NO: 553, SEQ ID NO: 559, SEQ ID NO: 565, SEQ ID NO: 571, SEQ ID NO: 577, SEQ ID NO: 583, SEQ ID NO: 589, SEQ ID NO: 595, SEQ ID NO: 601, SEQ ID NO: 607, SEQ ID NO: 613, SEQ ID NO: 619, SEQ ID NO: 625, SEQ ID NO: 631, SEQ ID NO: 637, SEQ ID NO: 643, SEQ ID NO: 649, SEQ ID NO: 655, SEQ ID NO: 661, SEQ ID NO: 667, SEQ ID NO: 673, SEQ ID NO: 679, SEQ ID NO: 685, SEQ ID NO: 691, SEQ ID NO: 697, SEQ ID NO: 703, SEQ ID NO: 709, SEQ ID NO: 715, SEQ ID NO: 721, SEQ ID NO: 727, SEQ ID NO: 733, SEQ ID NO: 739, SEQ ID NO: 745, SEQ ID NO: 751, SEQ ID NO: 757, SEQ ID NO: 763, SEQ ID NO: 769, SEQ ID NO: 775, SEQ ID NO: 781, SEQ ID NO: 787, SEQ ID NO: 793, SEQ ID NO: 799, SEQ ID NO: 805, SEQ ID NO: 811, SEQ ID NO: 817, SEQ ID NO: 823, SEQ ID NO: 829, SEQ ID NO: 835, SEQ ID NO: 841, SEQ ID NO: 847, SEQ ID NO: 853, SEQ ID NO: 859, SEQ ID NO: 865, SEQ ID NO: 871, SEQ ID NO: 877, SEQ ID NO: 883, SEQ ID NO: 889, SEQ ID NO: 895, SEQ ID NO: 901, SEQ ID NO: 907, SEQ ID NO: 913, SEQ ID NO: 919, SEQ ID NO: 925, SEQ ID NO: 931, SEQ ID NO: 937, SEQ ID NO: 943, SEQ ID NO: 949, SEQ ID NO: 955, SEQ ID NO: 961, SEQ ID NO: 967, SEQ ID NO: 973, SEQ ID NO: 979, SEQ ID NO: 985, SEQ ID NO: 991, SEQ ID NO: 997, SEQ ID NO: 1003, SEQ ID NO: 1009, SEQ ID NO: 1015, SEQ ID NO: 1021, SEQ ID NO: 1027, SEQ ID NO: 1033, SEQ ID NO: 1039, SEQ ID NO: 1045, SEQ ID NO: 1051, SEQ ID NO: 1057, SEQ ID NO: 1063, SEQ ID NO: 1069, SEQ ID NO: 1075, SEQ ID NO: 1081, SEQ ID NO: 1087, SEQ ID NO: 1093, SEQ ID NO: 1099, SEQ ID NO: 1105, SEQ ID NO: 1111, SEQ ID NO: 1117, SEQ ID NO: 1123, SEQ ID NO: 1129, SEQ ID NO: 1135, SEQ ID NO: 1141, SEQ ID NO: 1147, SEQ ID NO: 1153, SEQ ID NO: 1159, SEQ ID NO: 1165, SEQ ID NO: 1171, SEQ ID NO: 1177, SEQ ID NO: 1183, SEQ ID NO: 1189, SEQ ID NO: 1195, SEQ ID NO: 1201, SEQ ID NO: 1207, SEQ ID NO: 1213, SEQ ID NO: 1219, SEQ ID NO: 1225, SEQ ID NO: 1231, SEQ ID NO: 1237, SEQ ID NO: 1243, SEQ ID NO: 1249, SEQ ID NO: 1255, SEQ ID NO: 1261, SEQ ID NO: 1267, SEQ ID NO: 1273, SEQ ID NO: 1279, SEQ ID NO: 1285, SEQ ID NO: 1291, SEQ ID NO: 1297, SEQ ID NO: 1303, SEQ ID NO: 1309, SEQ ID NO: 1315, SEQ ID NO: 1321, SEQ ID NO: 1327, SEQ ID NO: 1333, SEQ ID NO: 1339, SEQ ID NO: 1345, SEQ ID NO: 1351, SEQ ID NO: 1357, SEQ ID NO: 1363, SEQ ID NO: 1369, SEQ ID NO: 1375, SEQ ID NO: 1381, SEQ ID NO: 1387, SEQ ID NO: 1393, SEQ ID NO: 1399, SEQ ID NO: 1405, SEQ ID NO: 1411, SEQ ID NO: 1417, SEQ ID NO: 1423, SEQ ID NO: 1429, SEQ ID NO: 1435, SEQ ID NO: 1441, SEQ ID NO: 1447, SEQ ID NO: 1453, SEQ ID NO: 1459, SEQ ID NO: 1465, SEQ ID NO: 1471, SEQ ID NO: 1477, SEQ ID NO: 1483, SEQ ID NO: 1489, SEQ ID NO: 1495, SEQ ID NO: 1501, SEQ ID NO: 1507, SEQ ID NO: 1513, SEQ ID NO: 1519, SEQ ID NO: 1593, SEQ ID NO: 1525 SEQ ID NO: 1531, SEQ ID NO: 1537, SEQ ID NO: 1543, SEQ ID NO: 1549, SEQ ID NO: 1555, SEQ ID NO: 1561, SEQ ID NO: 1567, SEQ ID NO: 1573, SEQ ID NO: 1579, or SEQ ID NO: 1585 as shown in FIGS. 3A, 3B, 3C, 3D, 3E, 3F, 3G, 3H, 3I, 3J, 3K, or 3L, a heavy chain CDR2 comprising the amino acid sequence of any one of the HCDR2s in SEQ ID NO: 398, SEQ ID NO: 404, SEQ ID NO: 410, SEQ ID NO: 416, SEQ ID NO: 422, SEQ ID NO: 428, SEQ ID NO: 434, SEQ ID NO: 440, SEQ ID NO: 446, SEQ ID NO: 452, SEQ ID NO: 458, SEQ ID NO: 464, SEQ ID NO: 470, SEQ ID NO: 476, SEQ ID NO: 482, SEQ ID NO: 488, SEQ ID NO: 494, SEQ ID NO: 500, SEQ ID NO: 506, SEQ ID NO: 512, SEQ ID NO: 518, SEQ ID NO: 524, SEQ ID NO: 530, SEQ ID NO: 536, SEQ ID NO: 542, SEQ ID NO: 548, SEQ ID NO: 554, SEQ ID NO: 560, SEQ ID NO: 566, SEQ ID NO: 572, SEQ ID NO: 578, SEQ ID NO: 584, SEQ ID NO: 590, SEQ ID NO: 596, SEQ ID NO: 602, SEQ ID NO: 608, SEQ ID NO: 614, SEQ ID NO: 620, SEQ ID NO: 626, SEQ ID NO: 632, SEQ ID NO: 638, SEQ ID NO: 644, SEQ ID NO: 650, SEQ ID NO: 656, SEQ ID NO: 662, SEQ ID NO: 668, SEQ ID NO: 674, SEQ ID NO: 680, SEQ ID NO: 686, SEQ ID NO: 692, SEQ ID NO: 698, SEQ ID NO: 704, SEQ ID NO: 710, SEQ ID NO: 716, SEQ ID NO: 722, SEQ ID NO: 728, SEQ ID NO: 734, SEQ ID NO: 740, SEQ ID NO: 746, SEQ ID NO: 752, SEQ ID NO: 758, SEQ ID NO: 764, SEQ ID NO: 770, SEQ ID NO: 776, SEQ ID NO: 782, SEQ ID NO: 788, SEQ ID NO: 794, SEQ ID NO: 800, SEQ ID NO: 806, SEQ ID NO: 812, SEQ ID NO: 818, SEQ ID NO: 824, SEQ ID NO: 830, SEQ ID NO: 836, SEQ ID NO: 842, SEQ ID NO: 848, SEQ ID NO: 854, SEQ ID NO: 860, SEQ ID NO: 866, SEQ ID NO: 872, SEQ ID NO: 878, SEQ ID NO: 884, SEQ ID NO: 890, SEQ ID NO: 896, SEQ ID NO: 902, SEQ ID NO: 908, SEQ ID NO: 914, SEQ ID NO: 920, SEQ ID NO: 926, SEQ ID NO: 932, SEQ ID NO: 938, SEQ ID NO: 944, SEQ ID NO: 950, SEQ ID NO: 956, SEQ ID NO: 962, SEQ ID NO: 968, SEQ ID NO: 974, SEQ ID NO: 980, SEQ ID NO: 986, SEQ ID NO: 992, SEQ ID NO: 998, SEQ ID NO: 1004, SEQ ID NO: 1010, SEQ ID NO: 1016, SEQ ID NO: 1022, SEQ ID NO: 1028, SEQ ID NO: 1034, SEQ ID NO: 1040, SEQ ID NO: 1046, SEQ ID NO: 1052, SEQ ID NO: 1058, SEQ ID NO: 1064, SEQ ID NO: 1070, SEQ ID NO: 1076, SEQ ID NO: 1082, SEQ ID NO: 1088, SEQ ID NO: 1094, SEQ ID NO: 1100, SEQ ID NO: 1106, SEQ ID NO: 1112, SEQ ID NO: 1118, SEQ ID NO: 1124, SEQ ID NO: 1130, SEQ ID NO: 1136, SEQ ID NO: 1142, SEQ ID NO: 1148, SEQ ID NO: 1154, SEQ ID NO: 1160, SEQ ID NO: 1166, SEQ ID NO: 1172, SEQ ID NO: 1178, SEQ ID NO: 1184, SEQ ID NO: 1190, SEQ ID NO: 1196, SEQ ID NO: 1202, SEQ ID NO: 1208, SEQ ID NO: 1214, SEQ ID NO: 1220, SEQ ID NO: 1226, SEQ ID NO: 1232, SEQ ID NO: 1238, SEQ ID NO: 1244, SEQ ID NO: 1250, SEQ ID NO: 1256, SEQ ID NO: 1262, SEQ ID NO: 1268, SEQ ID NO: 1274, SEQ ID NO: 1280, SEQ ID NO: 1286, SEQ ID NO: 1292, SEQ ID NO: 1298, SEQ ID NO: 1304, SEQ ID NO: 1310, SEQ ID NO: 1316, SEQ ID NO: 1322, SEQ ID NO: 1328, SEQ ID NO: 1334, SEQ ID NO: 1340, SEQ ID NO: 1346, SEQ ID NO: 1352, SEQ ID NO: 1358, SEQ ID NO: 1364, SEQ ID NO: 1370, SEQ ID NO: 1376, SEQ ID NO: 1382, SEQ ID NO: 1388, SEQ ID NO: 1394, SEQ ID NO: 1400, SEQ ID NO: 1406, SEQ ID NO: 1412, SEQ ID NO: 1418, SEQ ID NO: 1424, SEQ ID NO: 1430, SEQ ID NO: 1436, SEQ ID NO: 1442, SEQ ID NO: 1448, SEQ ID NO: 1454, SEQ ID NO: 1460, SEQ ID NO: 1466, SEQ ID NO: 1472, SEQ ID NO: 1478, SEQ ID NO: 1484, SEQ ID NO: 1490, SEQ ID NO: 1496, SEQ ID NO: 1502, SEQ ID NO: 1508, SEQ ID NO: 1514, SEQ ID NO: 1520, SEQ ID NO: 1594, SEQ ID NO: 1526, SEQ ID NO: 1532, SEQ ID NO: 1538, SEQ ID NO: 1544, SEQ ID NO: 1550, SEQ ID NO: 1556, SEQ ID NO: 1562, SEQ ID NO: 1568, SEQ ID NO: 1574, SEQ ID NO: 1580, or SEQ ID NO: 1586 as shown in FIGS. 3A, 3B, 3C, 3D, 3E, 3F, 3G, 3H, 3I, 3J, 3K, or 3L, and a heavy chain CDR3 comprising the amino acid sequence of any one of the HCDR3s in SEQ ID NO: 399, SEQ ID NO: 405, SEQ ID NO: 411, SEQ ID NO: 417, SEQ ID NO: 423, SEQ ID NO: 429, SEQ ID NO: 435, SEQ ID NO: 441, SEQ ID NO: 447, SEQ ID NO: 453, SEQ ID NO: 459, SEQ ID NO: 465, SEQ ID NO: 471, SEQ ID NO: 477, SEQ ID NO: 483, SEQ ID NO: 489, SEQ ID NO: 495, SEQ ID NO: 501, SEQ ID NO: 507, SEQ ID NO: 513, SEQ ID NO: 519, SEQ ID NO: 525, SEQ ID NO: 531, SEQ ID NO: 537, SEQ ID NO: 543, SEQ ID NO: 549, SEQ ID NO: 555, SEQ ID NO: 561, SEQ ID NO: 567, SEQ ID NO: 573, SEQ ID NO: 579, SEQ ID NO: 585, SEQ ID NO: 591, SEQ ID NO: 597, SEQ ID NO: 603, SEQ ID NO: 609, SEQ ID NO: 615, SEQ ID NO: 621, SEQ ID NO: 627, SEQ ID NO: 633, SEQ ID NO: 639, SEQ ID NO: 645, SEQ ID NO: 651, SEQ ID NO: 657, SEQ ID NO: 663, SEQ ID NO: 669, SEQ ID NO: 675, SEQ ID NO: 681, SEQ ID NO: 687, SEQ ID NO: 693, SEQ ID NO: 699, SEQ ID NO: 705, SEQ ID NO: 711, SEQ ID NO: 717, SEQ ID NO: 723, SEQ ID NO: 729, SEQ ID NO: 735, SEQ ID NO: 741, SEQ ID NO: 747, SEQ ID NO: 753, SEQ ID NO: 759, SEQ ID NO: 765, SEQ ID NO: 771, SEQ ID NO: 777, SEQ ID NO: 783, SEQ ID NO: 789, SEQ ID NO: 795, SEQ ID NO: 801, SEQ ID NO: 807, SEQ ID NO: 813, SEQ ID NO: 819, SEQ ID NO: 825, SEQ ID NO: 831, SEQ ID NO: 837, SEQ ID NO: 843, SEQ ID NO: 849, SEQ ID NO: 855, SEQ ID NO: 861, SEQ ID NO: 867, SEQ ID NO: 873, SEQ ID NO: 879, SEQ ID NO: 885, SEQ ID NO: 891, SEQ ID NO: 897, SEQ ID NO: 903, SEQ ID NO: 909, SEQ ID NO: 915, SEQ ID NO: 921, SEQ ID NO: 927, SEQ ID NO: 933, SEQ ID NO: 939, SEQ ID NO: 945, SEQ ID NO: 951, SEQ ID NO: 957, SEQ ID NO: 963, SEQ ID NO: 969, SEQ ID NO: 975, SEQ ID NO: 981, SEQ ID NO: 987, SEQ ID NO: 993, SEQ ID NO: 999, SEQ ID NO: 1005, SEQ ID NO: 1011, SEQ ID NO: 1017, SEQ ID NO: 1023, SEQ ID NO: 1029, SEQ ID NO: 1035, SEQ ID NO: 1041, SEQ ID NO: 1047, SEQ ID NO: 1053, SEQ ID NO: 1059, SEQ ID NO: 1065, SEQ ID NO: 1071, SEQ ID NO: 1077, SEQ ID NO: 1083, SEQ ID NO: 1089, SEQ ID NO: 1095, SEQ ID NO: 1101, SEQ ID NO: 1107, SEQ ID NO: 1113, SEQ ID NO: 1119, SEQ ID NO: 1125, SEQ ID NO: 1131, SEQ ID NO: 1137, SEQ ID NO: 1143, SEQ ID NO: 1149, SEQ ID NO: 1155, SEQ ID NO: 1161, SEQ ID NO: 1167, SEQ ID NO: 1173, SEQ ID NO: 1179, SEQ ID NO: 1185, SEQ ID NO: 1191, SEQ ID NO: 1197, SEQ ID NO: 1203, SEQ ID NO: 1209, SEQ ID NO: 1215, SEQ ID NO: 1221, SEQ ID NO: 1227, SEQ ID NO: 1233, SEQ ID NO: 1239, SEQ ID NO: 1245, SEQ ID NO: 1251, SEQ ID NO: 1257, SEQ ID NO: 1263, SEQ ID NO: 1269, SEQ ID NO: 1275, SEQ ID NO: 1281, SEQ ID NO: 1287, SEQ ID NO: 1293, SEQ ID NO: 1299, SEQ ID NO: 1305, SEQ ID NO: 1311, SEQ ID NO: 1317, SEQ ID NO: 1323, SEQ ID NO: 1329, SEQ ID NO: 1335, SEQ ID NO: 1341, SEQ ID NO: 1347, SEQ ID NO: 1353, SEQ ID NO: 1359, SEQ ID NO: 1365, SEQ ID NO: 1371, SEQ ID NO: 1377, SEQ ID NO: 1383, SEQ ID NO: 1389, SEQ ID NO: 1395, SEQ ID NO: 1401, SEQ ID NO: 1407, SEQ ID NO: 1413, SEQ ID NO: 1419, SEQ ID NO: 1425, SEQ ID NO: 1431, SEQ ID NO: 1437, SEQ ID NO: 1443, SEQ ID NO: 1449, SEQ ID NO: 1455, SEQ ID NO: 1461, SEQ ID NO: 1467, SEQ ID NO: 1473, SEQ ID NO: 1479, SEQ ID NO: 1485, SEQ ID NO: 1491, SEQ ID NO: 1497, SEQ ID NO: 1503, SEQ ID NO: 1509, SEQ ID NO: 1515, SEQ ID NO: 1521, SEQ ID NO: 1595, SEQ ID NO: 1527, SEQ ID NO: 1533, SEQ ID NO: 1539, SEQ ID NO: 1545, SEQ ID NO: 1551, SEQ ID NO: 1557, SEQ ID NO: 1563, SEQ ID NO: 1569, SEQ ID NO: 1575, SEQ ID NO: 1581, or SEQ ID NO: 1587 as shown in FIGS. 3A, 3B, 3C, 3D, 3E, 3F, 3G, 3H, 3I, 3J, 3K, or 3L, and the HCDR1, HCDR2, and HCDR3 are from a same clone In some embodiments, an isolated antigen binding molecule that binds to human TIGIT comprises a heavy chain CDR1 comprising the amino acid sequence of any of one of the HCDR1s in SEQ ID NO: 397, SEQ ID NO: 403. SEQ ID NO: 409, SEQ ID NO: 415, SEQ ID NO: 421, SEQ ID NO: 427, SEQ ID NO: 433, SEQ ID NO: 439, SEQ ID NO: 445, SEQ ID NO: 451, SEQ ID NO: 457, SEQ ID NO: 463, SEQ ID NO: 469, SEQ ID NO: 475, SEQ ID NO: 481, SEQ ID NO: 487, SEQ ID NO: 493, SEQ ID NO: 499, SEQ ID NO: 505, SEQ ID NO: 511, SEQ ID NO: 517, SEQ ID NO: 523, SEQ ID NO: 529, SEQ ID NO: 535, SEQ ID NO: 541, SEQ ID NO: 547, SEQ ID NO: 553, SEQ ID NO: 559, SEQ ID NO: 565, SEQ ID NO: 571, SEQ ID NO: 577, SEQ ID NO: 583, SEQ ID NO: 589, SEQ ID NO: 595, SEQ ID NO: 601, SEQ ID NO: 607, SEQ ID NO: 613, SEQ ID NO: 619, SEQ ID NO: 625, SEQ ID NO: 631, SEQ ID NO: 637, SEQ ID NO: 643, SEQ ID NO: 649, SEQ ID NO: 655, SEQ ID NO: 661, SEQ ID NO: 667, SEQ ID NO: 673, SEQ ID NO: 679, SEQ ID NO: 685, SEQ ID NO: 691, SEQ ID NO: 697, SEQ ID NO: 703, SEQ ID NO: 709, SEQ ID NO: 715, SEQ ID NO: 721, SEQ ID NO: 727, SEQ ID NO: 733, SEQ ID NO: 739, SEQ ID NO: 745, SEQ ID NO: 751, SEQ ID NO: 757, SEQ ID NO: 763, SEQ ID NO: 769, SEQ ID NO: 775, SEQ ID NO: 781, SEQ ID NO: 787, SEQ ID NO: 793, SEQ ID NO: 799, SEQ ID NO: 805, SEQ ID NO: 811, SEQ ID NO: 817, SEQ ID NO: 823, SEQ ID NO: 829, SEQ ID NO: 835, SEQ ID NO: 841, SEQ ID NO: 847, SEQ ID NO: 853, SEQ ID NO: 859, SEQ ID NO: 865, SEQ ID NO: 871, SEQ ID NO: 877, SEQ ID NO: 883, SEQ ID NO: 889, SEQ ID NO: 895, SEQ ID NO: 901, SEQ ID NO: 907, SEQ ID NO: 913, SEQ ID NO: 919, SEQ ID NO: 925, SEQ ID NO: 931, SEQ ID NO: 937, SEQ ID NO: 943, SEQ ID NO: 949, SEQ ID NO: 955, SEQ ID NO: 961, SEQ ID NO: 967, SEQ ID NO: 973, SEQ ID NO: 979, SEQ ID NO: 985, SEQ ID NO: 991, SEQ ID NO: 997, SEQ ID NO: 1003, SEQ ID NO: 1009, SEQ ID NO: 1015, SEQ ID NO: 1021, SEQ ID NO: 1027, SEQ ID NO: 1033, SEQ ID NO: 1039, SEQ ID NO: 1045, SEQ ID NO: 1051, SEQ ID NO: 1057, SEQ ID NO: 1063, SEQ ID NO: 1069, SEQ ID NO: 1075, SEQ ID NO: 1081, SEQ ID NO: 1087, SEQ ID NO: 1093, SEQ ID NO: 1099, SEQ ID NO: 1105, SEQ ID NO: 1111, SEQ ID NO: 1117, SEQ ID NO: 1123, SEQ ID NO: 1129, SEQ ID NO: 1135, SEQ ID NO: 1141, SEQ ID NO: 1147, SEQ ID NO: 1153, SEQ ID NO: 1159, SEQ ID NO: 1165, SEQ ID NO: 1171, SEQ ID NO: 1177, SEQ ID NO: 1183, SEQ ID NO: 1189, SEQ ID NO: 1195, SEQ ID NO: 1201, SEQ ID NO: 1207, SEQ ID NO: 1213, SEQ ID NO: 1219, SEQ ID NO: 1225, SEQ ID NO: 1231, SEQ ID NO: 1237, SEQ ID NO: 1243, SEQ ID NO: 1249, SEQ ID NO: 1255, SEQ ID NO: 1261, SEQ ID NO: 1267, SEQ ID NO: 1273, SEQ ID NO: 1279, SEQ ID NO: 1285, SEQ ID NO: 1291, SEQ ID NO: 1297, SEQ ID NO: 1303, SEQ ID NO: 1309, SEQ ID NO: 1315, SEQ ID NO: 1321, SEQ ID NO: 1327, SEQ ID NO: 1333, SEQ ID NO: 1339, SEQ ID NO: 1345, SEQ ID NO: 1351, SEQ ID NO: 1357, SEQ ID NO: 1363, SEQ ID NO: 1369, SEQ ID NO: 1375, SEQ ID NO: 1381, SEQ ID NO: 1387, SEQ ID NO: 1393, SEQ ID NO: 1399, SEQ ID NO: 1405, SEQ ID NO: 1411, SEQ ID NO: 1417, SEQ ID NO: 1423, SEQ ID NO: 1429, SEQ ID NO: 1435, SEQ ID NO: 1441, SEQ ID NO: 1447, SEQ ID NO: 1453, SEQ ID NO: 1459, SEQ ID NO: 1465, SEQ ID NO: 1471, SEQ ID NO: 1477, SEQ ID NO: 1483, SEQ ID NO: 1489, SEQ ID NO: 1495, SEQ ID NO: 1501, SEQ ID NO: 1507, SEQ ID NO: 1513, SEQ ID NO: 1519, SEQ ID NO: 1593, SEQ ID NO: 1525 SEQ ID NO: 1531, SEQ ID NO: 1537, SEQ ID NO: 1543, SEQ ID NO: 1549, SEQ ID NO: 1555, SEQ ID NO: 1561, SEQ ID NO: 1567, SEQ ID NO: 1573, SEQ ID NO: 1579, or SEQ ID NO: 1585 as shown in FIGS. 3A, 3B, 3C, 3D, 3E, 3F, 3G, 3H, 3I, 3J, 3K, or 3L, a heavy chain CDR2 comprising the amino acid sequence of any one of the HCDR2s in SEQ ID NO: 398, SEQ ID NO: 404, SEQ ID NO: 410, SEQ ID NO: 416, SEQ ID NO: 422, SEQ ID NO: 428, SEQ ID NO: 434, SEQ ID NO: 440, SEQ ID NO: 446, SEQ ID NO: 452, SEQ ID NO: 458, SEQ ID NO: 464, SEQ ID NO: 470, SEQ ID NO: 476, SEQ ID NO: 482, SEQ ID NO: 488, SEQ ID NO: 494, SEQ ID NO: 500, SEQ ID NO: 506, SEQ ID NO: 512, SEQ ID NO: 518, SEQ ID NO: 524, SEQ ID NO: 530, SEQ ID NO: 536, SEQ ID NO: 542, SEQ ID NO: 548, SEQ ID NO: 554, SEQ ID NO: 560, SEQ ID NO: 566, SEQ ID NO: 572, SEQ ID NO: 578, SEQ ID NO: 584, SEQ ID NO: 590, SEQ ID NO: 596, SEQ ID NO: 602, SEQ ID NO: 608, SEQ ID NO: 614, SEQ ID NO: 620, SEQ ID NO: 626, SEQ ID NO: 632, SEQ ID NO: 638, SEQ ID NO: 644, SEQ ID NO: 650, SEQ ID NO: 656, SEQ ID NO: 662, SEQ ID NO: 668, SEQ ID NO: 674, SEQ ID NO: 680, SEQ ID NO: 686, SEQ ID NO: 692, SEQ ID NO: 698, SEQ ID NO: 704, SEQ ID NO: 710, SEQ ID NO: 716, SEQ ID NO: 722, SEQ ID NO: 728, SEQ ID NO: 734, SEQ ID NO: 740, SEQ ID NO: 746, SEQ ID NO: 752, SEQ ID NO: 758, SEQ ID NO: 764, SEQ ID NO: 770, SEQ ID NO: 776, SEQ ID NO: 782, SEQ ID NO: 788, SEQ ID NO: 794, SEQ ID NO: 800, SEQ ID NO: 806, SEQ ID NO: 812, SEQ ID NO: 818, SEQ ID NO: 824, SEQ ID NO: 830, SEQ ID NO: 836, SEQ ID NO: 842, SEQ ID NO: 848, SEQ ID NO: 854, SEQ ID NO: 860, SEQ ID NO: 866, SEQ ID NO: 872, SEQ ID NO: 878, SEQ ID NO: 884, SEQ ID NO: 890, SEQ ID NO: 896, SEQ ID NO: 902, SEQ ID NO: 908, SEQ ID NO: 914, SEQ ID NO: 920, SEQ ID NO: 926, SEQ ID NO: 932, SEQ ID NO: 938, SEQ ID NO: 944, SEQ ID NO: 950, SEQ ID NO: 956, SEQ ID NO: 962, SEQ ID NO: 968, SEQ ID NO: 974, SEQ ID NO: 980, SEQ ID NO: 986, SEQ ID NO: 992, SEQ ID NO: 998, SEQ ID NO: 1004, SEQ ID NO: 1010, SEQ ID NO: 1016, SEQ ID NO: 1022, SEQ ID NO: 1028, SEQ ID NO: 1034, SEQ ID NO: 1040, SEQ ID NO: 1046, SEQ ID NO: 1052, SEQ ID NO: 1058, SEQ ID NO: 1064, SEQ ID NO: 1070, SEQ ID NO: 1076, SEQ ID NO: 1082, SEQ ID NO: 1088, SEQ ID NO: 1094, SEQ ID NO: 1100, SEQ ID NO: 1106, SEQ ID NO: 1112, SEQ ID NO: 1118, SEQ ID NO: 1124, SEQ ID NO: 1130, SEQ ID NO: 1136, SEQ ID NO: 1142, SEQ ID NO: 1148, SEQ ID NO: 1154, SEQ ID NO: 1160, SEQ ID NO: 1166, SEQ ID NO: 1172, SEQ ID NO: 1178, SEQ ID NO: 1184, SEQ ID NO: 1190, SEQ ID NO: 1196, SEQ ID NO: 1202, SEQ ID NO: 1208, SEQ ID NO: 1214, SEQ ID NO: 1220, SEQ ID NO: 1226, SEQ ID NO: 1232, SEQ ID NO: 1238, SEQ ID NO: 1244, SEQ ID NO: 1250, SEQ ID NO: 1256, SEQ ID NO: 1262, SEQ ID NO: 1268, SEQ ID NO: 1274, SEQ ID NO: 1280, SEQ ID NO: 1286, SEQ ID NO: 1292, SEQ ID NO: 1298, SEQ ID NO: 1304, SEQ ID NO: 1310, SEQ ID NO: 1316, SEQ ID NO: 1322, SEQ ID NO: 1328, SEQ ID NO: 1334, SEQ ID NO: 1340, SEQ ID NO: 1346, SEQ ID NO: 1352, SEQ ID NO: 1358, SEQ ID NO: 1364, SEQ ID NO: 1370, SEQ ID NO: 1376, SEQ ID NO: 1382, SEQ ID NO: 1388, SEQ ID NO: 1394, SEQ ID NO: 1400, SEQ ID NO: 1406, SEQ ID NO: 1412, SEQ ID NO: 1418, SEQ ID NO: 1424, SEQ ID NO: 1430, SEQ ID NO: 1436, SEQ ID NO: 1442, SEQ ID NO: 1448, SEQ ID NO: 1454, SEQ ID NO: 1460, SEQ ID NO: 1466, SEQ ID NO: 1472, SEQ ID NO: 1478, SEQ ID NO: 1484, SEQ ID NO: 1490, SEQ ID NO: 1496, SEQ ID NO: 1502, SEQ ID NO: 1508, SEQ ID NO: 1514, SEQ ID NO: 1520, SEQ ID NO: 1594, SEQ ID NO: 1526, SEQ ID NO: 1532, SEQ ID NO: 1538, SEQ ID NO: 1544, SEQ ID NO: 1550, SEQ ID NO: 1556, SEQ ID NO: 1562, SEQ ID NO: 1568, SEQ ID NO: 1574, SEQ ID NO: 1580, or SEQ ID NO: 1586 as shown in FIGS. 3A, 3B, 3C, 3D, 3E, 3F, 3G, 3H, 3I, 3J, 3K, or 3L, a heavy chain CDR3 comprising the amino acid sequence of any one of the HCDR3s in SEQ ID NO: 399, SEQ ID NO: 405, SEQ ID NO: 411, SEQ ID NO: 417, SEQ ID NO: 423, SEQ ID NO: 429, SEQ ID NO: 435, SEQ ID NO: 441, SEQ ID NO: 447, SEQ ID NO: 453, SEQ ID NO: 459, SEQ ID NO: 465, SEQ ID NO: 471, SEQ ID NO: 477, SEQ ID NO: 483, SEQ ID NO: 489, SEQ ID NO: 495, SEQ ID NO: 501, SEQ ID NO: 507, SEQ ID NO: 513, SEQ ID NO: 519, SEQ ID NO: 525, SEQ ID NO: 531, SEQ ID NO: 537, SEQ ID NO: 543, SEQ ID NO: 549, SEQ ID NO: 555, SEQ ID NO: 561, SEQ ID NO: 567, SEQ ID NO: 573, SEQ ID NO: 579, SEQ ID NO: 585, SEQ ID NO: 591, SEQ ID NO: 597, SEQ ID NO: 603, SEQ ID NO: 609, SEQ ID NO: 615, SEQ ID NO: 621, SEQ ID NO: 627, SEQ ID NO: 633, SEQ ID NO: 639, SEQ ID NO: 645, SEQ ID NO: 651, SEQ ID NO: 657, SEQ ID NO: 663, SEQ ID NO: 669, SEQ ID NO: 675, SEQ ID NO: 681, SEQ ID NO: 687, SEQ ID NO: 693, SEQ ID NO: 699, SEQ ID NO: 705, SEQ ID NO: 711, SEQ ID NO: 717, SEQ ID NO: 723, SEQ ID NO: 729, SEQ ID NO: 735, SEQ ID NO: 741, SEQ ID NO: 747, SEQ ID NO: 753, SEQ ID NO: 759, SEQ ID NO: 765, SEQ ID NO: 771, SEQ ID NO: 777, SEQ ID NO: 783, SEQ ID NO: 789, SEQ ID NO: 795, SEQ ID NO: 801, SEQ ID NO: 807, SEQ ID NO: 813, SEQ ID NO: 819, SEQ ID NO: 825, SEQ ID NO: 831, SEQ ID NO: 837, SEQ ID NO: 843, SEQ ID NO: 849, SEQ ID NO: 855, SEQ ID NO: 861, SEQ ID NO: 867, SEQ ID NO: 873, SEQ ID NO: 879, SEQ ID NO: 885, SEQ ID NO: 891, SEQ ID NO: 897, SEQ ID NO: 903, SEQ ID NO: 909, SEQ ID NO: 915, SEQ ID NO: 921, SEQ ID NO: 927, SEQ ID NO: 933, SEQ ID NO: 939, SEQ ID NO: 945, SEQ ID NO: 951, SEQ ID NO: 957, SEQ ID NO: 963, SEQ ID NO: 969, SEQ ID NO: 975, SEQ ID NO: 981, SEQ ID NO: 987, SEQ ID NO: 993, SEQ ID NO: 999, SEQ ID NO: 1005, SEQ ID NO: 1011, SEQ ID NO: 1017, SEQ ID NO: 1023, SEQ ID NO: 1029, SEQ ID NO: 1035, SEQ ID NO: 1041, SEQ ID NO: 1047, SEQ ID NO: 1053, SEQ ID NO: 1059, SEQ ID NO: 1065, SEQ ID NO: 1071, SEQ ID NO: 1077, SEQ ID NO: 1083, SEQ ID NO: 1089, SEQ ID NO: 1095, SEQ ID NO: 1101, SEQ ID NO: 1107, SEQ ID NO: 1113, SEQ ID NO: 1119, SEQ ID NO: 1125, SEQ ID NO: 1131, SEQ ID NO: 1137, SEQ ID NO: 1143, SEQ ID NO: 1149, SEQ ID NO: 1155, SEQ ID NO: 1161, SEQ ID NO: 1167, SEQ ID NO: 1173, SEQ ID NO: 1179, SEQ ID NO: 1185, SEQ ID NO: 1191, SEQ ID NO: 1197, SEQ ID NO: 1203, SEQ ID NO: 1209, SEQ ID NO: 1215, SEQ ID NO: 1221, SEQ ID NO: 1227, SEQ ID NO: 1233, SEQ ID NO: 1239, SEQ ID NO: 1245, SEQ ID NO: 1251, SEQ ID NO: 1257, SEQ ID NO: 1263, SEQ ID NO: 1269, SEQ ID NO: 1275, SEQ ID NO: 1281, SEQ ID NO: 1287, SEQ ID NO: 1293, SEQ ID NO: 1299, SEQ ID NO: 1305, SEQ ID NO: 1311, SEQ ID NO: 1317, SEQ ID NO: 1323, SEQ ID NO: 1329, SEQ ID NO: 1335, SEQ ID NO: 1341, SEQ ID NO: 1347, SEQ ID NO: 1353, SEQ ID NO: 1359, SEQ ID NO: 1365, SEQ ID NO: 1371, SEQ ID NO: 1377, SEQ ID NO: 1383, SEQ ID NO: 1389, SEQ ID NO: 1395, SEQ ID NO: 1401, SEQ ID NO: 1407, SEQ ID NO: 1413, SEQ ID NO: 1419, SEQ ID NO: 1425, SEQ ID NO: 1431, SEQ ID NO: 1437, SEQ ID NO: 1443, SEQ ID NO: 1449, SEQ ID NO: 1455, SEQ ID NO: 1461, SEQ ID NO: 1467, SEQ ID NO: 1473, SEQ ID NO: 1479, SEQ ID NO: 1485, SEQ ID NO: 1491, SEQ ID NO: 1497, SEQ ID NO: 1503, SEQ ID NO: 1509, SEQ ID NO: 1515, SEQ ID NO: 1521, SEQ ID NO: 1595, SEQ ID NO: 1527, SEQ ID NO: 1533, SEQ ID NO: 1539, SEQ ID NO: 1545, SEQ ID NO: 1551, SEQ ID NO: 1557, SEQ ID NO: 1563, SEQ ID NO: 1569, SEQ ID NO: 1575, SEQ ID NO: 1581, or SEQ ID NO: 1587 as shown in FIGS. 3A, 3B, 3C, 3D, 3E, 3F, 3G, 3H, 3I, 3J, 3K, or 3L, a light chain CDR1 comprising the amino acid sequence of any one of the LCDR1s in SEQ ID NO: 400, SEQ ID NO: 406, SEQ ID NO: 412, SEQ ID NO: 418, SEQ ID NO: 424, SEQ ID NO: 430, SEQ ID NO: 436, SEQ ID NO: 442, SEQ ID NO: 448, SEQ ID NO: 454, SEQ ID NO: 460, SEQ ID NO: 466, SEQ ID NO: 472, SEQ ID NO: 478, SEQ ID NO: 484, SEQ ID NO: 490, SEQ ID NO: 496, SEQ ID NO: 502, SEQ ID NO: 508, SEQ ID NO: 514, SEQ ID NO: 520, SEQ ID NO: 526, SEQ ID NO: 532, SEQ ID NO: 538, SEQ ID NO: 544, SEQ ID NO: 550, SEQ ID NO: 556, SEQ ID NO: 562, SEQ ID NO: 568, SEQ ID NO: 574, SEQ ID NO: 580, SEQ ID NO: 586, SEQ ID NO: 592, SEQ ID NO: 598, SEQ ID NO: 604, SEQ ID NO: 610, SEQ ID NO: 616, SEQ ID NO: 622, SEQ ID NO: 628, SEQ ID NO: 634, SEQ ID NO: 640, SEQ ID NO: 646, SEQ ID NO: 652, SEQ ID NO: 658, SEQ ID NO: 664, SEQ ID NO: 670, SEQ ID NO: 676, SEQ ID NO: 682, SEQ ID NO: 688, SEQ ID NO: 694, SEQ ID NO: 700, SEQ ID NO: 706, SEQ ID NO: 712, SEQ ID NO: 718, SEQ ID NO: 724, SEQ ID NO: 730, SEQ ID NO: 736, SEQ ID NO: 742, SEQ ID NO: 748, SEQ ID NO: 754, SEQ ID NO: 760, SEQ ID NO: 766, SEQ ID NO: 772, SEQ ID NO: 778, SEQ ID NO: 784, SEQ ID NO: 790, SEQ ID NO: 796, SEQ ID NO: 802, SEQ ID NO: 808, SEQ ID NO: 814, SEQ ID NO: 820, SEQ ID NO: 826, SEQ ID NO: 832, SEQ ID NO: 838, SEQ ID NO: 844, SEQ ID NO: 850, SEQ ID NO: 856, SEQ ID NO: 862, SEQ ID NO: 868, SEQ ID NO: 874, SEQ ID NO: 880, SEQ ID NO: 886, SEQ ID NO: 892, SEQ ID NO: 898, SEQ ID NO: 904, SEQ ID NO: 910, SEQ ID NO: 916, SEQ ID NO: 922, SEQ ID NO: 928, SEQ ID NO: 934, SEQ ID NO: 940, SEQ ID NO: 946, SEQ ID NO: 952, SEQ ID NO: 958, SEQ ID NO: 964, SEQ ID NO: 970, SEQ ID NO: 976, SEQ ID NO: 982, SEQ ID NO: 988, SEQ ID NO: 994, SEQ ID NO: 1000, SEQ ID NO: 1006, SEQ ID NO: 1012, SEQ ID NO: 1018, SEQ ID NO: 1024, SEQ ID NO: 1030, SEQ ID NO: 1036, SEQ ID NO: 1042, SEQ ID NO: 1048, SEQ ID NO: 1054, SEQ ID NO: 1060, SEQ ID NO: 1066, SEQ ID NO: 1072, SEQ ID NO: 1078, SEQ ID NO: 1084, SEQ ID NO: 1090, SEQ ID NO: 1096, SEQ ID NO: 1102, SEQ ID NO: 1108, SEQ ID NO: 1114, SEQ ID NO: 1120, SEQ ID NO: 1126, SEQ ID NO: 1132, SEQ ID NO: 1138, SEQ ID NO: 1144, SEQ ID NO: 1150, SEQ ID NO: 1156, SEQ ID NO: 1162, SEQ ID NO: 1168, SEQ ID NO: 1174, SEQ ID NO: 1180, SEQ ID NO: 1186, SEQ ID NO: 1192, SEQ ID NO: 1198, SEQ ID NO: 1204, SEQ ID NO: 1210, SEQ ID NO: 1216, SEQ ID NO: 1222, SEQ ID NO: 1228, SEQ ID NO: 1234, SEQ ID NO: 1240, SEQ ID NO: 1246, SEQ ID NO: 1252, SEQ ID NO: 1258, SEQ ID NO: 1264, SEQ ID NO: 1270, SEQ ID NO: 1276, SEQ ID NO: 1282, SEQ ID NO: 1288, SEQ ID NO: 1294, SEQ ID NO: 1300, SEQ ID NO: 1306, SEQ ID NO: 1312, SEQ ID NO: 1318, SEQ ID NO: 1324, SEQ ID NO: 1330, SEQ ID NO: 1336, SEQ ID NO: 1342, SEQ ID NO: 1348, SEQ ID NO: 1354, SEQ ID NO: 1360, SEQ ID NO: 1366, SEQ ID NO: 1372, SEQ ID NO: 1378, SEQ ID NO: 1384, SEQ ID NO: 1390, SEQ ID NO: 1396, SEQ ID NO: 1402, SEQ ID NO: 1408, SEQ ID NO: 1414, SEQ ID NO: 1420, SEQ ID NO: 1426, SEQ ID NO: 1432, SEQ ID NO: 1438, SEQ ID NO: 1444, SEQ ID NO: 1450. SEQ ID NO: 1456, SEQ ID NO: 1462, SEQ ID NO: 1468, SEQ ID NO: 1474, SEQ ID NO: 1480, SEQ ID NO: 1486, SEQ ID NO: 1492, SEQ ID NO: 1498, SEQ ID NO: 1504, SEQ ID NO: 1510, SEQ ID NO: 1516, SEQ ID NO: 1522, SEQ ID NO: 1596, SEQ ID NO: 1528, SEQ ID NO: 1534, SEQ ID NO: 1540, SEQ ID NO: 1546, SEQ ID NO: 1552, SEQ ID NO: 1558, SEQ ID NO: 1564, SEQ ID NO: 1570, SEQ ID NO: 1576, SEQ ID NO: 1582, or SEQ ID NO: 1588 as shown in FIGS. 3A, 3B, 3C, 3D, 3E, 3F, 3G, 3H, 3I, 3J, 3K, or 3L, a light chain CDR2 comprising the amino acid sequence of any one of the LCDR2s in SEQ ID NO: 401, SEQ ID NO: 407, SEQ ID NO: 413, SEQ ID NO: 419, SEQ ID NO: 425, SEQ ID NO: 431, SEQ ID NO: 437, SEQ ID NO: 443, SEQ ID NO: 449, SEQ ID NO: 455, SEQ ID NO: 461, SEQ ID NO: 467, SEQ ID NO: 473, SEQ ID NO: 479, SEQ ID NO: 485, SEQ ID NO: 491, SEQ ID NO: 497, SEQ ID NO: 503, SEQ ID NO: 509, SEQ ID NO: 515, SEQ ID NO: 521, SEQ ID NO: 527, SEQ ID NO: 533, SEQ ID NO: 539, SEQ ID NO: 545, SEQ ID NO: 551, SEQ ID NO: 557, SEQ ID NO: 563, SEQ ID NO: 569, SEQ ID NO: 575, SEQ ID NO: 581, SEQ ID NO: 587, SEQ ID NO: 593, SEQ ID NO: 599, SEQ ID NO: 605, SEQ ID NO: 611, SEQ ID NO: 617, SEQ ID NO: 623, SEQ ID NO: 629, SEQ ID NO: 635, SEQ ID NO: 641, SEQ ID NO: 647, SEQ ID NO: 653, SEQ ID NO: 659, SEQ ID NO: 665, SEQ ID NO: 671, SEQ ID NO: 677, SEQ ID NO: 683, SEQ ID NO: 689, SEQ ID NO: 695, SEQ ID NO: 701, SEQ ID NO: 707, SEQ ID NO: 713, SEQ ID NO: 719, SEQ ID NO: 725, SEQ ID NO: 731, SEQ ID NO: 737, SEQ ID NO: 743, SEQ ID NO: 749, SEQ ID NO: 755, SEQ ID NO: 761, SEQ ID NO: 767, SEQ ID NO: 773, SEQ ID NO: 779, SEQ ID NO: 785, SEQ ID NO: 791, SEQ ID NO: 797, SEQ ID NO: 803, SEQ ID NO: 809, SEQ ID NO: 815, SEQ ID NO: 821, SEQ ID NO: 827, SEQ ID NO: 833, SEQ ID NO: 839, SEQ ID NO: 845, SEQ ID NO: 851, SEQ ID NO: 857, SEQ ID NO: 863, SEQ ID NO: 869, SEQ ID NO: 875, SEQ ID NO: 881, SEQ ID NO: 887, SEQ ID NO: 893, SEQ ID NO: 899, SEQ ID NO: 905, SEQ ID NO: 911, SEQ ID NO: 917, SEQ ID NO: 923, SEQ ID NO: 929, SEQ ID NO: 935, SEQ ID NO: 941, SEQ ID NO: 947, SEQ ID NO: 953, SEQ ID NO: 959, SEQ ID NO: 965, SEQ ID NO: 971, SEQ ID NO: 977, SEQ ID NO: 983, SEQ ID NO: 989, SEQ ID NO: 995, SEQ ID NO: 1001, SEQ ID NO: 1007, SEQ ID NO: 1013, SEQ ID NO: 1019, SEQ ID NO: 1025, SEQ ID NO: 1031, SEQ ID NO: 1037, SEQ ID NO: 1043, SEQ ID NO: 1049, SEQ ID NO: 1055, SEQ ID NO: 1061, SEQ ID NO: 1067, SEQ ID NO: 1073, SEQ ID NO: 1079, SEQ ID NO: 1085, SEQ ID NO: 1091, SEQ ID NO: 1097, SEQ ID NO: 1103, SEQ ID NO: 1109, SEQ ID NO: 1115, SEQ ID NO: 1121, SEQ ID NO: 1127, SEQ ID NO: 1133, SEQ ID NO: 1139, SEQ ID NO: 1145, SEQ ID NO: 1151, SEQ ID NO: 1157, SEQ ID NO: 1163, SEQ ID NO: 1169, SEQ ID NO: 1175, SEQ ID NO: 1181, SEQ ID NO: 1187, SEQ ID NO: 1193, SEQ ID NO: 1199, SEQ ID NO: 1205, SEQ ID NO: 1211, SEQ ID NO: 1217, SEQ ID NO: 1223, SEQ ID NO: 1229, SEQ ID NO: 1235, SEQ ID NO: 1241, SEQ ID NO: 1247, SEQ ID NO: 1253, SEQ ID NO: 1259, SEQ ID NO: 1265, SEQ ID NO: 1271, SEQ ID NO: 1277, SEQ ID NO: 1283, SEQ ID NO: 1289, SEQ ID NO: 1295, SEQ ID NO: 1301, SEQ ID NO: 1307, SEQ ID NO: 1313, SEQ ID NO: 1319, SEQ ID NO: 1325, SEQ ID NO: 1331, SEQ ID NO: 1337, SEQ ID NO: 1343, SEQ ID NO: 1349, SEQ ID NO: 1355, SEQ ID NO: 1361, SEQ ID NO: 1367, SEQ ID NO: 1373, SEQ ID NO: 1379, SEQ ID NO: 1385, SEQ ID NO: 1391, SEQ ID NO: 1397, SEQ ID NO: 1403, SEQ ID NO: 1409, SEQ ID NO: 1415, SEQ ID NO: 1421, SEQ ID NO: 1427, SEQ ID NO: 1433, SEQ ID NO: 1439, SEQ ID NO: 1445, SEQ ID NO: 1451, SEQ ID NO: 1457, SEQ ID NO: 1463, SEQ ID NO: 1469, SEQ ID NO: 1475, SEQ ID NO: 1481, SEQ ID NO: 1487, SEQ ID NO: 1493, SEQ ID NO: 1499, SEQ ID NO: 1505, SEQ ID NO: 1511, SEQ ID NO: 1517, SEQ ID NO: 1523, SEQ ID NO: 1597, SEQ ID NO: 1529, SEQ ID NO: 1535, SEQ ID NO: 1541, SEQ ID NO: 1547, SEQ ID NO: 1553, SEQ ID NO: 1559, SEQ ID NO: 1565, SEQ ID NO: 1571, SEQ ID NO: 1577, SEQ ID NO: 1583, or SEQ ID NO: 1589 as shown in FIGS. 3A, 3B, 3C, 3D, 3E, 3F, 3G, 3H, 3I, 3J, 3K, or 3L, and a light chain CDR3 comprising the amino acid sequence of any one of the LCDR3s in SEQ ID NO: 402, SEQ ID NO: 408, SEQ ID NO: 414, SEQ ID NO: 420, SEQ ID NO: 426, SEQ ID NO: 432, SEQ ID NO: 438, SEQ ID NO: 444, SEQ ID NO: 450, SEQ ID NO: 456, SEQ ID NO: 462, SEQ ID NO: 468, SEQ ID NO: 474, SEQ ID NO: 480, SEQ ID NO: 486, SEQ ID NO: 492, SEQ ID NO: 498, SEQ ID NO: 504, SEQ ID NO: 510, SEQ ID NO: 516, SEQ ID NO: 522, SEQ ID NO: 528, SEQ ID NO: 534, SEQ ID NO: 540, SEQ ID NO: 546, SEQ ID NO: 552, SEQ ID NO: 558, SEQ ID NO: 564, SEQ ID NO: 570, SEQ ID NO: 576, SEQ ID NO: 582, SEQ ID NO: 588, SEQ ID NO: 594, SEQ ID NO: 600, SEQ ID NO: 606, SEQ ID NO: 612, SEQ ID NO: 618, SEQ ID NO: 624, SEQ ID NO: 630, SEQ ID NO: 636, SEQ ID NO: 642, SEQ ID NO: 648, SEQ ID NO: 654, SEQ ID NO: 660, SEQ ID NO: 666, SEQ ID NO: 672, SEQ ID NO: 678, SEQ ID NO: 684, SEQ ID NO: 690, SEQ ID NO: 696, SEQ ID NO: 702, SEQ ID NO: 708, SEQ ID NO: 714, SEQ ID NO: 720, SEQ ID NO: 726, SEQ ID NO: 732, SEQ ID NO: 738, SEQ ID NO: 744, SEQ ID NO: 750, SEQ ID NO: 756, SEQ ID NO: 762, SEQ ID NO: 768, SEQ ID NO: 774, SEQ ID NO: 780, SEQ ID NO: 786, SEQ ID NO: 792, SEQ ID NO: 798, SEQ ID NO: 804, SEQ ID NO: 810, SEQ ID NO: 816, SEQ ID NO: 822, SEQ ID NO: 828, SEQ ID NO: 834, SEQ ID NO: 840, SEQ ID NO: 846, SEQ ID NO: 852, SEQ ID NO: 858, SEQ ID NO: 864, SEQ ID NO: 870, SEQ ID NO: 876, SEQ ID NO: 882, SEQ ID NO: 888, SEQ ID NO: 894, SEQ ID NO: 900, SEQ ID NO: 906, SEQ ID NO: 912, SEQ ID NO: 918, SEQ ID NO: 924, SEQ ID NO: 930, SEQ ID NO: 936, SEQ ID NO: 942, SEQ ID NO: 948, SEQ ID NO: 954, SEQ ID NO: 960, SEQ ID NO: 966, SEQ ID NO: 972, SEQ ID NO: 978, SEQ ID NO: 984, SEQ ID NO: 990, SEQ ID NO: 996, SEQ ID NO: 1002, SEQ ID NO: 1008, SEQ ID NO: 1014, SEQ ID NO: 1020, SEQ ID NO: 1026, SEQ ID NO: 1032, SEQ ID NO: 1038, SEQ ID NO: 1044, SEQ ID NO: 1050, SEQ ID NO: 1056, SEQ ID NO: 1062, SEQ ID NO: 1068, SEQ ID NO: 1074, SEQ ID NO: 1080, SEQ ID NO: 1086, SEQ ID NO: 1092, SEQ ID NO: 1098, SEQ ID NO: 1104, SEQ ID NO: 1110, SEQ ID NO: 1116, SEQ ID NO: 1122, SEQ ID NO: 1128, SEQ ID NO: 1134, SEQ ID NO: 1140, SEQ ID NO: 1146, SEQ ID NO: 1152, SEQ ID NO: 1158, SEQ ID NO: 1164, SEQ ID NO: 1170, SEQ ID NO: 1176, SEQ ID NO: 1182, SEQ ID NO: 1188, SEQ ID NO: 1194, SEQ ID NO: 1200, SEQ ID NO: 1206, SEQ ID NO: 1212, SEQ ID NO: 1218, SEQ ID NO: 1224, SEQ ID NO: 1230, SEQ ID NO: 1236, SEQ ID NO: 1242, SEQ ID NO: 1248, SEQ ID NO: 1254, SEQ ID NO: 1260, SEQ ID NO: 1266, SEQ ID NO: 1272, SEQ ID NO: 1278, SEQ ID NO: 1284, SEQ ID NO: 1290, SEQ ID NO: 1296, SEQ ID NO: 1302, SEQ ID NO: 1308, SEQ ID NO: 1314, SEQ ID NO: 1320, SEQ ID NO: 1326, SEQ ID NO: 1332, SEQ ID NO: 1338, SEQ ID NO: 1344, SEQ ID NO: 1350, SEQ ID NO: 1356, SEQ ID NO: 1362, SEQ ID NO: 1368, SEQ ID NO: 1374, SEQ ID NO: 1380, SEQ ID NO: 1386, SEQ ID NO: 1392, SEQ ID NO: 1398, SEQ ID NO: 1404, SEQ ID NO: 1410, SEQ ID NO: 1416, SEQ ID NO: 1422, SEQ ID NO: 1428, SEQ ID NO: 1434, SEQ ID NO: 1440, SEQ ID NO: 1446, SEQ ID NO: 1452, SEQ ID NO: 1458, SEQ ID NO: 1464, SEQ ID NO: 1470, SEQ ID NO: 1476, SEQ ID NO: 1482, SEQ ID NO: 1488, SEQ ID NO: 1494, SEQ ID NO: 1500, SEQ ID NO: 1506, SEQ ID NO: 1512, SEQ ID NO: 1518, SEQ ID NO: 1524, SEQ ID NO: 1598, SEQ ID NO: 1530, SEQ ID NO: 1536, SEQ ID NO: 1542, SEQ ID NO: 1548, SEQ ID NO: 1554, SEQ ID NO: 1560, SEQ ID NO: 1566, SEQ ID NO: 1572, SEQ ID NO: 1578, SEQ ID NO: 1584, or SEQ ID NO: 1590 as shown in FIGS. 3A, 3B, 3C, 3D, 3E, 3F, 3G, 3H, 3I, 3J, 3K, or 3L.

In some embodiments, an isolated antigen binding molecule that binds to human TIGIT comprises a heavy chain CDR1 comprising the amino acid sequence of any of one of the HCDR1s in SEQ ID NO: 397, SEQ ID NO: 403. SEQ ID NO: 409, SEQ ID NO: 415, SEQ ID NO: 421, SEQ ID NO: 427, SEQ ID NO: 433, SEQ ID NO: 439, SEQ ID NO: 445, SEQ ID NO: 451, SEQ ID NO: 457, SEQ ID NO: 463, SEQ ID NO: 469, SEQ ID NO: 475, SEQ ID NO: 481, SEQ ID NO: 487, SEQ ID NO: 493, SEQ ID NO: 499, SEQ ID NO: 505, SEQ ID NO: 511, SEQ ID NO: 517, SEQ ID NO: 523, SEQ ID NO: 529, SEQ ID NO: 535, SEQ ID NO: 541, SEQ ID NO: 547, SEQ ID NO: 553, SEQ ID NO: 559, SEQ ID NO: 565, SEQ ID NO: 571, SEQ ID NO: 577, SEQ ID NO: 583, SEQ ID NO: 589, SEQ ID NO: 595, SEQ ID NO: 601, SEQ ID NO: 607, SEQ ID NO: 613, SEQ ID NO: 619, SEQ ID NO: 625, SEQ ID NO: 631, SEQ ID NO: 637, SEQ ID NO: 643, SEQ ID NO: 649, SEQ ID NO: 655, SEQ ID NO: 661, SEQ ID NO: 667, SEQ ID NO: 673, SEQ ID NO: 679, SEQ ID NO: 685, SEQ ID NO: 691, SEQ ID NO: 697, SEQ ID NO: 703, SEQ ID NO: 709, SEQ ID NO: 715, SEQ ID NO: 721, SEQ ID NO: 727, SEQ ID NO: 733, SEQ ID NO: 739, SEQ ID NO: 745, SEQ ID NO: 751, SEQ ID NO: 757, SEQ ID NO: 763, SEQ ID NO: 769, SEQ ID NO: 775, SEQ ID NO: 781, SEQ ID NO: 787, SEQ ID NO: 793, SEQ ID NO: 799, SEQ ID NO: 805, SEQ ID NO: 811, SEQ ID NO: 817, SEQ ID NO: 823, SEQ ID NO: 829, SEQ ID NO: 835, SEQ ID NO: 841, SEQ ID NO: 847, SEQ ID NO: 853, SEQ ID NO: 859, SEQ ID NO: 865, SEQ ID NO: 871, SEQ ID NO: 877, SEQ ID NO: 883, SEQ ID NO: 889, SEQ ID NO: 895, SEQ ID NO: 901, SEQ ID NO: 907, SEQ ID NO: 913, SEQ ID NO: 919, SEQ ID NO: 925, SEQ ID NO: 931, SEQ ID NO: 937, SEQ ID NO: 943, SEQ ID NO: 949, SEQ ID NO: 955, SEQ ID NO: 961, SEQ ID NO: 967, SEQ ID NO: 973, SEQ ID NO: 979, SEQ ID NO: 985, SEQ ID NO: 991, SEQ ID NO: 997, SEQ ID NO: 1003, SEQ ID NO: 1009, SEQ ID NO: 1015, SEQ ID NO: 1021, SEQ ID NO: 1027, SEQ ID NO: 1033, SEQ ID NO: 1039, SEQ ID NO: 1045, SEQ ID NO: 1051, SEQ ID NO: 1057, SEQ ID NO: 1063, SEQ ID NO: 1069, SEQ ID NO: 1075, SEQ ID NO: 1081, SEQ ID NO: 1087, SEQ ID NO: 1093, SEQ ID NO: 1099, SEQ ID NO: 1105, SEQ ID NO: 1111, SEQ ID NO: 1117, SEQ ID NO: 1123, SEQ ID NO: 1129, SEQ ID NO: 1135, SEQ ID NO: 1141, SEQ ID NO: 1147, SEQ ID NO: 1153, SEQ ID NO: 1159, SEQ ID NO: 1165, SEQ ID NO: 1171, SEQ ID NO: 1177, SEQ ID NO: 1183, SEQ ID NO: 1189, SEQ ID NO: 1195, SEQ ID NO: 1201, SEQ ID NO: 1207, SEQ ID NO: 1213, SEQ ID NO: 1219, SEQ ID NO: 1225, SEQ ID NO: 1231, SEQ ID NO: 1237, SEQ ID NO: 1243, SEQ ID NO: 1249, SEQ ID NO: 1255, SEQ ID NO: 1261, SEQ ID NO: 1267, SEQ ID NO: 1273, SEQ ID NO: 1279, SEQ ID NO: 1285, SEQ ID NO: 1291, SEQ ID NO: 1297, SEQ ID NO: 1303, SEQ ID NO: 1309, SEQ ID NO: 1315, SEQ ID NO: 1321, SEQ ID NO: 1327, SEQ ID NO: 1333, SEQ ID NO: 1339, SEQ ID NO: 1345, SEQ ID NO: 1351, SEQ ID NO: 1357, SEQ ID NO: 1363, SEQ ID NO: 1369, SEQ ID NO: 1375, SEQ ID NO: 1381, SEQ ID NO: 1387, SEQ ID NO: 1393, SEQ ID NO: 1399, SEQ ID NO: 1405, SEQ ID NO: 1411, SEQ ID NO: 1417, SEQ ID NO: 1423, SEQ ID NO: 1429, SEQ ID NO: 1435, SEQ ID NO: 1441, SEQ ID NO: 1447, SEQ ID NO: 1453, SEQ ID NO: 1459, SEQ ID NO: 1465, SEQ ID NO: 1471, SEQ ID NO: 1477, SEQ ID NO: 1483, SEQ ID NO: 1489, SEQ ID NO: 1495, SEQ ID NO: 1501, SEQ ID NO: 1507, SEQ ID NO: 1513, SEQ ID NO: 1519, SEQ ID NO: 1593, SEQ ID NO: 1525 SEQ ID NO: 1531, SEQ ID NO: 1537, SEQ ID NO: 1543, SEQ ID NO: 1549, SEQ ID NO: 1555, SEQ ID NO: 1561, SEQ ID NO: 1567, SEQ ID NO: 1573, SEQ ID NO: 1579, or SEQ ID NO: 1585 as shown in FIGS. 3A, 3B, 3C, 3D, 3E, 3F, 3G, 3H, 3I, 3J, 3K, or 3L, a heavy chain CDR2 comprising the amino acid sequence of any one of the HCDR2s in SEQ ID NO: 398, SEQ ID NO: 404, SEQ ID NO: 410, SEQ ID NO: 416, SEQ ID NO: 422, SEQ ID NO: 428, SEQ ID NO: 434, SEQ ID NO: 440, SEQ ID NO: 446, SEQ ID NO: 452, SEQ ID NO: 458, SEQ ID NO: 464, SEQ ID NO: 470, SEQ ID NO: 476, SEQ ID NO: 482, SEQ ID NO: 488, SEQ ID NO: 494, SEQ ID NO: 500, SEQ ID NO: 506, SEQ ID NO: 512, SEQ ID NO: 518, SEQ ID NO: 524, SEQ ID NO: 530, SEQ ID NO: 536, SEQ ID NO: 542, SEQ ID NO: 548, SEQ ID NO: 554, SEQ ID NO: 560, SEQ ID NO: 566, SEQ ID NO: 572, SEQ ID NO: 578, SEQ ID NO: 584, SEQ ID NO: 590, SEQ ID NO: 596, SEQ ID NO: 602, SEQ ID NO: 608, SEQ ID NO: 614, SEQ ID NO: 620, SEQ ID NO: 626, SEQ ID NO: 632, SEQ ID NO: 638, SEQ ID NO: 644, SEQ ID NO: 650, SEQ ID NO: 656, SEQ ID NO: 662, SEQ ID NO: 668, SEQ ID NO: 674, SEQ ID NO: 680, SEQ ID NO: 686, SEQ ID NO: 692, SEQ ID NO: 698, SEQ ID NO: 704, SEQ ID NO: 710, SEQ ID NO: 716, SEQ ID NO: 722, SEQ ID NO: 728, SEQ ID NO: 734, SEQ ID NO: 740, SEQ ID NO: 746, SEQ ID NO: 752, SEQ ID NO: 758, SEQ ID NO: 764, SEQ ID NO: 770, SEQ ID NO: 776, SEQ ID NO: 782, SEQ ID NO: 788, SEQ ID NO: 794, SEQ ID NO: 800, SEQ ID NO: 806, SEQ ID NO: 812, SEQ ID NO: 818, SEQ ID NO: 824, SEQ ID NO: 830, SEQ ID NO: 836, SEQ ID NO: 842, SEQ ID NO: 848, SEQ ID NO: 854, SEQ ID NO: 860, SEQ ID NO: 866, SEQ ID NO: 872, SEQ ID NO: 878, SEQ ID NO: 884, SEQ ID NO: 890, SEQ ID NO: 896, SEQ ID NO: 902, SEQ ID NO: 908, SEQ ID NO: 914, SEQ ID NO: 920, SEQ ID NO: 926, SEQ ID NO: 932, SEQ ID NO: 938, SEQ ID NO: 944, SEQ ID NO: 950, SEQ ID NO: 956, SEQ ID NO: 962, SEQ ID NO: 968, SEQ ID NO: 974, SEQ ID NO: 980, SEQ ID NO: 986, SEQ ID NO: 992, SEQ ID NO: 998, SEQ ID NO: 1004, SEQ ID NO: 1010, SEQ ID NO: 1016, SEQ ID NO: 1022, SEQ ID NO: 1028, SEQ ID NO: 1034, SEQ ID NO: 1040, SEQ ID NO: 1046, SEQ ID NO: 1052, SEQ ID NO: 1058, SEQ ID NO: 1064, SEQ ID NO: 1070, SEQ ID NO: 1076, SEQ ID NO: 1082, SEQ ID NO: 1088, SEQ ID NO: 1094, SEQ ID NO: 1100, SEQ ID NO: 1106, SEQ ID NO: 1112, SEQ ID NO: 1118, SEQ ID NO: 1124, SEQ ID NO: 1130, SEQ ID NO: 1136, SEQ ID NO: 1142, SEQ ID NO: 1148, SEQ ID NO: 1154, SEQ ID NO: 1160, SEQ ID NO: 1166, SEQ ID NO: 1172, SEQ ID NO: 1178, SEQ ID NO: 1184, SEQ ID NO: 1190, SEQ ID NO: 1196, SEQ ID NO: 1202, SEQ ID NO: 1208, SEQ ID NO: 1214, SEQ ID NO: 1220, SEQ ID NO: 1226, SEQ ID NO: 1232, SEQ ID NO: 1238, SEQ ID NO: 1244, SEQ ID NO: 1250, SEQ ID NO: 1256, SEQ ID NO: 1262, SEQ ID NO: 1268, SEQ ID NO: 1274, SEQ ID NO: 1280, SEQ ID NO: 1286, SEQ ID NO: 1292, SEQ ID NO: 1298, SEQ ID NO: 1304, SEQ ID NO: 1310, SEQ ID NO: 1316, SEQ ID NO: 1322, SEQ ID NO: 1328, SEQ ID NO: 1334, SEQ ID NO: 1340, SEQ ID NO: 1346, SEQ ID NO: 1352, SEQ ID NO: 1358, SEQ ID NO: 1364, SEQ ID NO: 1370, SEQ ID NO: 1376, SEQ ID NO: 1382, SEQ ID NO: 1388, SEQ ID NO: 1394, SEQ ID NO: 1400, SEQ ID NO: 1406, SEQ ID NO: 1412, SEQ ID NO: 1418, SEQ ID NO: 1424, SEQ ID NO: 1430, SEQ ID NO: 1436, SEQ ID NO: 1442, SEQ ID NO: 1448, SEQ ID NO: 1454, SEQ ID NO: 1460, SEQ ID NO: 1466, SEQ ID NO: 1472, SEQ ID NO: 1478, SEQ ID NO: 1484, SEQ ID NO: 1490, SEQ ID NO: 1496, SEQ ID NO: 1502, SEQ ID NO: 1508, SEQ ID NO: 1514, SEQ ID NO: 1520, SEQ ID NO: 1594, SEQ ID NO: 1526, SEQ ID NO: 1532, SEQ ID NO: 1538, SEQ ID NO: 1544, SEQ ID NO: 1550, SEQ ID NO: 1556, SEQ ID NO: 1562, SEQ ID NO: 1568, SEQ ID NO: 1574, SEQ ID NO: 1580, or SEQ ID NO: 1586 as shown in FIGS. 3A, 3B, 3C, 3D, 3E, 3F, 3G, 3H, 3I, 3J, 3K, or 3L, a heavy chain CDR3 comprising the amino acid sequence of any one of the HCDR3s in SEQ ID NO: 399, SEQ ID NO: 405, SEQ ID NO: 411, SEQ ID NO: 417, SEQ ID NO: 423, SEQ ID NO: 429, SEQ ID NO: 435, SEQ ID NO: 441, SEQ ID NO: 447, SEQ ID NO: 453, SEQ ID NO: 459, SEQ ID NO: 465, SEQ ID NO: 471, SEQ ID NO: 477, SEQ ID NO: 483, SEQ ID NO: 489, SEQ ID NO: 495, SEQ ID NO: 501, SEQ ID NO: 507, SEQ ID NO: 513, SEQ ID NO: 519, SEQ ID NO: 525, SEQ ID NO: 531, SEQ ID NO: 537, SEQ ID NO: 543, SEQ ID NO: 549, SEQ ID NO: 555, SEQ ID NO: 561, SEQ ID NO: 567, SEQ ID NO: 573, SEQ ID NO: 579, SEQ ID NO: 585, SEQ ID NO: 591, SEQ ID NO: 597, SEQ ID NO: 603, SEQ ID NO: 609, SEQ ID NO: 615, SEQ ID NO: 621, SEQ ID NO: 627, SEQ ID NO: 633, SEQ ID NO: 639, SEQ ID NO: 645, SEQ ID NO: 651, SEQ ID NO: 657, SEQ ID NO: 663, SEQ ID NO: 669, SEQ ID NO: 675, SEQ ID NO: 681, SEQ ID NO: 687, SEQ ID NO: 693, SEQ ID NO: 699, SEQ ID NO: 705, SEQ ID NO: 711, SEQ ID NO: 717, SEQ ID NO: 723, SEQ ID NO: 729, SEQ ID NO: 735, SEQ ID NO: 741, SEQ ID NO: 747, SEQ ID NO: 753, SEQ ID NO: 759, SEQ ID NO: 765, SEQ ID NO: 771, SEQ ID NO: 777, SEQ ID NO: 783, SEQ ID NO: 789, SEQ ID NO: 795, SEQ ID NO: 801, SEQ ID NO: 807, SEQ ID NO: 813, SEQ ID NO: 819, SEQ ID NO: 825, SEQ ID NO: 831, SEQ ID NO: 837, SEQ ID NO: 843, SEQ ID NO: 849, SEQ ID NO: 855, SEQ ID NO: 861, SEQ ID NO: 867, SEQ ID NO: 873, SEQ ID NO: 879, SEQ ID NO: 885, SEQ ID NO: 891, SEQ ID NO: 897, SEQ ID NO: 903, SEQ ID NO: 909, SEQ ID NO: 915, SEQ ID NO: 921, SEQ ID NO: 927, SEQ ID NO: 933, SEQ ID NO: 939, SEQ ID NO: 945, SEQ ID NO: 951, SEQ ID NO: 957, SEQ ID NO: 963, SEQ ID NO: 969, SEQ ID NO: 975, SEQ ID NO: 981, SEQ ID NO: 987, SEQ ID NO: 993, SEQ ID NO: 999, SEQ ID NO: 1005, SEQ ID NO: 1011, SEQ ID NO: 1017, SEQ ID NO: 1023, SEQ ID NO: 1029, SEQ ID NO: 1035, SEQ ID NO: 1041, SEQ ID NO: 1047, SEQ ID NO: 1053, SEQ ID NO: 1059, SEQ ID NO: 1065, SEQ ID NO: 1071, SEQ ID NO: 1077, SEQ ID NO: 1083, SEQ ID NO: 1089, SEQ ID NO: 1095, SEQ ID NO: 1101, SEQ ID NO: 1107, SEQ ID NO: 1113, SEQ ID NO: 1119, SEQ ID NO: 1125, SEQ ID NO: 1131, SEQ ID NO: 1137, SEQ ID NO: 1143, SEQ ID NO: 1149, SEQ ID NO: 1155, SEQ ID NO: 1161, SEQ ID NO: 1167, SEQ ID NO: 1173, SEQ ID NO: 1179, SEQ ID NO: 1185, SEQ ID NO: 1191, SEQ ID NO: 1197, SEQ ID NO: 1203, SEQ ID NO: 1209, SEQ ID NO: 1215, SEQ ID NO: 1221, SEQ ID NO: 1227, SEQ ID NO: 1233, SEQ ID NO: 1239, SEQ ID NO: 1245, SEQ ID NO: 1251, SEQ ID NO: 1257, SEQ ID NO: 1263, SEQ ID NO: 1269, SEQ ID NO: 1275, SEQ ID NO: 1281, SEQ ID NO: 1287, SEQ ID NO: 1293, SEQ ID NO: 1299, SEQ ID NO: 1305, SEQ ID NO: 1311, SEQ ID NO: 1317, SEQ ID NO: 1323, SEQ ID NO: 1329, SEQ ID NO: 1335, SEQ ID NO: 1341, SEQ ID NO: 1347, SEQ ID NO: 1353, SEQ ID NO: 1359, SEQ ID NO: 1365, SEQ ID NO: 1371, SEQ ID NO: 1377, SEQ ID NO: 1383, SEQ ID NO: 1389, SEQ ID NO: 1395, SEQ ID NO: 1401, SEQ ID NO: 1407, SEQ ID NO: 1413, SEQ ID NO: 1419, SEQ ID NO: 1425, SEQ ID NO: 1431, SEQ ID NO: 1437, SEQ ID NO: 1443, SEQ ID NO: 1449, SEQ ID NO: 1455, SEQ ID NO: 1461, SEQ ID NO: 1467, SEQ ID NO: 1473, SEQ ID NO: 1479, SEQ ID NO: 1485, SEQ ID NO: 1491, SEQ ID NO: 1497, SEQ ID NO: 1503, SEQ ID NO: 1509, SEQ ID NO: 1515, SEQ ID NO: 1521, SEQ ID NO: 1595, SEQ ID NO: 1527, SEQ ID NO: 1533, SEQ ID NO: 1539, SEQ ID NO: 1545, SEQ ID NO: 1551, SEQ ID NO: 1557, SEQ ID NO: 1563, SEQ ID NO: 1569, SEQ ID NO: 1575, SEQ ID NO: 1581, or SEQ ID NO: 1587 as shown in FIGS. 3A, 3B, 3C, 3D, 3E, 3F, 3G, 3h, 3I, 3J, 3K, or 3L, a light chain CDR1 comprising the amino acid sequence of any one of the LCDR1s in SEQ ID NO: 400, SEQ ID NO: 406, SEQ ID NO: 412, SEQ ID NO: 418, SEQ ID NO: 424, SEQ ID NO: 430, SEQ ID NO: 436, SEQ ID NO: 442, SEQ ID NO: 448, SEQ ID NO: 454, SEQ ID NO: 460, SEQ ID NO: 466, SEQ ID NO: 472, SEQ ID NO: 478, SEQ ID NO: 484, SEQ ID NO: 490, SEQ ID NO: 496, SEQ ID NO: 502, SEQ ID NO: 508, SEQ ID NO: 514, SEQ ID NO: 520, SEQ ID NO: 526, SEQ ID NO: 532, SEQ ID NO: 538, SEQ ID NO: 544, SEQ ID NO: 550, SEQ ID NO: 556, SEQ ID NO: 562, SEQ ID NO: 568, SEQ ID NO: 574, SEQ ID NO: 580, SEQ ID NO: 586, SEQ ID NO: 592, SEQ ID NO: 598, SEQ ID NO: 604, SEQ ID NO: 610, SEQ ID NO: 616, SEQ ID NO: 622, SEQ ID NO: 628, SEQ ID NO: 634, SEQ ID NO: 640, SEQ ID NO: 646, SEQ ID NO: 652, SEQ ID NO: 658, SEQ ID NO: 664, SEQ ID NO: 670, SEQ ID NO: 676, SEQ ID NO: 682, SEQ ID NO: 688, SEQ ID NO: 694, SEQ ID NO: 700, SEQ ID NO: 706, SEQ ID NO: 712, SEQ ID NO: 718, SEQ ID NO: 724, SEQ ID NO: 730, SEQ ID NO: 736, SEQ ID NO: 742, SEQ ID NO: 748, SEQ ID NO: 754, SEQ ID NO: 760, SEQ ID NO: 766, SEQ ID NO: 772, SEQ ID NO: 778, SEQ ID NO: 784, SEQ ID NO: 790, SEQ ID NO: 796, SEQ ID NO: 802, SEQ ID NO: 808, SEQ ID NO: 814, SEQ ID NO: 820, SEQ ID NO: 826, SEQ ID NO: 832, SEQ ID NO: 838, SEQ ID NO: 844, SEQ ID NO: 850, SEQ ID NO: 856, SEQ ID NO: 862, SEQ ID NO: 868, SEQ ID NO: 874, SEQ ID NO: 880, SEQ ID NO: 886, SEQ ID NO: 892, SEQ ID NO: 898, SEQ ID NO: 904, SEQ ID NO: 910, SEQ ID NO: 916, SEQ ID NO: 922, SEQ ID NO: 928, SEQ ID NO: 934, SEQ ID NO: 940, SEQ ID NO: 946, SEQ ID NO: 952, SEQ ID NO: 958, SEQ ID NO: 964, SEQ ID NO: 970, SEQ ID NO: 976, SEQ ID NO: 982, SEQ ID NO: 988, SEQ ID NO: 994, SEQ ID NO: 1000, SEQ ID NO: 1006, SEQ ID NO: 1012, SEQ ID NO: 1018, SEQ ID NO: 1024, SEQ ID NO: 1030, SEQ ID NO: 1036, SEQ ID NO: 1042, SEQ ID NO: 1048, SEQ ID NO: 1054, SEQ ID NO: 1060, SEQ ID NO: 1066, SEQ ID NO: 1072, SEQ ID NO: 1078, SEQ ID NO: 1084, SEQ ID NO: 1090, SEQ ID NO: 1096, SEQ ID NO: 1102, SEQ ID NO: 1108, SEQ ID NO: 1114, SEQ ID NO: 1120, SEQ ID NO: 1126, SEQ ID NO: 1132, SEQ ID NO: 1138, SEQ ID NO: 1144, SEQ ID NO: 1150, SEQ ID NO: 1156, SEQ ID NO: 1162, SEQ ID NO: 1168, SEQ ID NO: 1174, SEQ ID NO: 1180, SEQ ID NO: 1186, SEQ ID NO: 1192, SEQ ID NO: 1198, SEQ ID NO: 1204, SEQ ID NO: 1210, SEQ ID NO: 1216, SEQ ID NO: 1222, SEQ ID NO: 1228, SEQ ID NO: 1234, SEQ ID NO: 1240, SEQ ID NO: 1246, SEQ ID NO: 1252, SEQ ID NO: 1258, SEQ ID NO: 1264, SEQ ID NO: 1270, SEQ ID NO: 1276, SEQ ID NO: 1282, SEQ ID NO: 1288, SEQ ID NO: 1294, SEQ ID NO: 1300, SEQ ID NO: 1306, SEQ ID NO: 1312, SEQ ID NO: 1318, SEQ ID NO: 1324, SEQ ID NO: 1330, SEQ ID NO: 1336, SEQ ID NO: 1342, SEQ ID NO: 1348, SEQ ID NO: 1354, SEQ ID NO: 1360, SEQ ID NO: 1366, SEQ ID NO: 1372, SEQ ID NO: 1378, SEQ ID NO: 1384, SEQ ID NO: 1390, SEQ ID NO: 1396, SEQ ID NO: 1402, SEQ ID NO: 1408, SEQ ID NO: 1414, SEQ ID NO: 1420, SEQ ID NO: 1426, SEQ ID NO: 1432, SEQ ID NO: 1438, SEQ ID NO: 1444, SEQ ID NO: 1450. SEQ ID NO: 1456, SEQ ID NO: 1462, SEQ ID NO: 1468, SEQ ID NO: 1474, SEQ ID NO: 1480, SEQ ID NO: 1486, SEQ ID NO: 1492, SEQ ID NO: 1498, SEQ ID NO: 1504, SEQ ID NO: 1510, SEQ ID NO: 1516, SEQ ID NO: 1522, SEQ ID NO: 1596, SEQ ID NO: 1528, SEQ ID NO: 1534, SEQ ID NO: 1540, SEQ ID NO: 1546, SEQ ID NO: 1552, SEQ ID NO: 1558, SEQ ID NO: 1564, SEQ ID NO: 1570, SEQ ID NO: 1576, SEQ ID NO: 1582, or SEQ ID NO: 1588 as shown in FIGS. 3A, 3B, 3C, 3D, 3E, 3F, 3G, 3H, 3I, 3J, 3K, or 3L, a light chain CDR2 comprising the amino acid sequence of any one of the LCDR2s in SEQ ID NO: 401, SEQ ID NO: 407, SEQ ID NO: 413, SEQ ID NO: 419, SEQ ID NO: 425, SEQ ID NO: 431, SEQ ID NO: 437, SEQ ID NO: 443, SEQ ID NO: 449, SEQ ID NO: 455, SEQ ID NO: 461, SEQ ID NO: 467, SEQ ID NO: 473, SEQ ID NO: 479, SEQ ID NO: 485, SEQ ID NO: 491, SEQ ID NO: 497, SEQ ID NO: 503, SEQ ID NO: 509, SEQ ID NO: 515, SEQ ID NO: 521, SEQ ID NO: 527, SEQ ID NO: 533, SEQ ID NO: 539, SEQ ID NO: 545, SEQ ID NO: 551, SEQ ID NO: 557, SEQ ID NO: 563, SEQ ID NO: 569, SEQ ID NO: 575, SEQ ID NO: 581, SEQ ID NO: 587, SEQ ID NO: 593, SEQ ID NO: 599, SEQ ID NO: 605, SEQ ID NO: 611, SEQ ID NO: 617, SEQ ID NO: 623, SEQ ID NO: 629, SEQ ID NO: 635, SEQ ID NO: 641, SEQ ID NO: 647, SEQ ID NO: 653, SEQ ID NO: 659, SEQ ID NO: 665, SEQ ID NO: 671, SEQ ID NO: 677, SEQ ID NO: 683, SEQ ID NO: 689, SEQ ID NO: 695, SEQ ID NO: 701, SEQ ID NO: 707, SEQ ID NO: 713, SEQ ID NO: 719, SEQ ID NO: 725, SEQ ID NO: 731, SEQ ID NO: 737, SEQ ID NO: 743, SEQ ID NO: 749, SEQ ID NO: 755, SEQ ID NO: 761, SEQ ID NO: 767, SEQ ID NO: 773, SEQ ID NO: 779, SEQ ID NO: 785, SEQ ID NO: 791, SEQ ID NO: 797, SEQ ID NO: 803, SEQ ID NO: 809, SEQ ID NO: 815, SEQ ID NO: 821, SEQ ID NO: 827, SEQ ID NO: 833, SEQ ID NO: 839, SEQ ID NO: 845, SEQ ID NO: 851, SEQ ID NO: 857, SEQ ID NO: 863, SEQ ID NO: 869, SEQ ID NO: 875, SEQ ID NO: 881, SEQ ID NO: 887, SEQ ID NO: 893, SEQ ID NO: 899, SEQ ID NO: 905, SEQ ID NO: 911, SEQ ID NO: 917, SEQ ID NO: 923, SEQ ID NO: 929, SEQ ID NO: 935, SEQ ID NO: 941, SEQ ID NO: 947, SEQ ID NO: 953, SEQ ID NO: 959, SEQ ID NO: 965, SEQ ID NO: 971, SEQ ID NO: 977, SEQ ID NO: 983, SEQ ID NO: 989, SEQ ID NO: 995, SEQ ID NO: 1001, SEQ ID NO: 1007, SEQ ID NO: 1013, SEQ ID NO: 1019, SEQ ID NO: 1025, SEQ ID NO: 1031, SEQ ID NO: 1037, SEQ ID NO: 1043, SEQ ID NO: 1049, SEQ ID NO: 1055, SEQ ID NO: 1061, SEQ ID NO: 1067, SEQ ID NO: 1073, SEQ ID NO: 1079, SEQ ID NO: 1085, SEQ ID NO: 1091, SEQ ID NO: 1097, SEQ ID NO: 1103, SEQ ID NO: 1109, SEQ ID NO: 1115, SEQ ID NO: 1121, SEQ ID NO: 1127, SEQ ID NO: 1133, SEQ ID NO: 1139, SEQ ID NO: 1145, SEQ ID NO: 1151, SEQ ID NO: 1157, SEQ ID NO: 1163, SEQ ID NO: 1169, SEQ ID NO: 1175, SEQ ID NO: 1181, SEQ ID NO: 1187, SEQ ID NO: 1193, SEQ ID NO: 1199, SEQ ID NO: 1205, SEQ ID NO: 1211, SEQ ID NO: 1217, SEQ ID NO: 1223, SEQ ID NO: 1229, SEQ ID NO: 1235, SEQ ID NO: 1241, SEQ ID NO: 1247, SEQ ID NO: 1253, SEQ ID NO: 1259, SEQ ID NO: 1265, SEQ ID NO: 1271, SEQ ID NO: 1277, SEQ ID NO: 1283, SEQ ID NO: 1289, SEQ ID NO: 1295, SEQ ID NO: 1301, SEQ ID NO: 1307, SEQ ID NO: 1313, SEQ ID NO: 1319, SEQ ID NO: 1325, SEQ ID NO: 1331, SEQ ID NO: 1337, SEQ ID NO: 1343, SEQ ID NO: 1349, SEQ ID NO: 1355, SEQ ID NO: 1361, SEQ ID NO: 1367, SEQ ID NO: 1373, SEQ ID NO: 1379, SEQ ID NO: 1385, SEQ ID NO: 1391, SEQ ID NO: 1397, SEQ ID NO: 1403, SEQ ID NO: 1409, SEQ ID NO: 1415, SEQ ID NO: 1421, SEQ ID NO: 1427, SEQ ID NO: 1433, SEQ ID NO: 1439, SEQ ID NO: 1445, SEQ ID NO: 1451, SEQ ID NO: 1457, SEQ ID NO: 1463, SEQ ID NO: 1469, SEQ ID NO: 1475, SEQ ID NO: 1481, SEQ ID NO: 1487, SEQ ID NO: 1493, SEQ ID NO: 1499, SEQ ID NO: 1505, SEQ ID NO: 1511, SEQ ID NO: 1517, SEQ ID NO: 1523, SEQ ID NO: 1597, SEQ ID NO: 1529, SEQ ID NO: 1535, SEQ ID NO: 1541, SEQ ID NO: 1547, SEQ ID NO: 1553, SEQ ID NO: 1559, SEQ ID NO: 1565, SEQ ID NO: 1571, SEQ ID NO: 1577, SEQ ID NO: 1583, or SEQ ID NO: 1589 as shown in FIGS. 3A, 3B, 3C, 3D, 3E, 3F, 3G, 3H, 3I, 3J, 3K, or 3L, and a light chain CDR3 comprising the amino acid sequence of any one of the LCDR3s in SEQ ID NO: 402, SEQ ID NO: 408, SEQ ID NO: 414, SEQ ID NO: 420, SEQ ID NO: 426, SEQ ID NO: 432, SEQ ID NO: 438, SEQ ID NO: 444, SEQ ID NO: 450, SEQ ID NO: 456, SEQ ID NO: 462, SEQ ID NO: 468, SEQ ID NO: 474, SEQ ID NO: 480, SEQ ID NO: 486, SEQ ID NO: 492, SEQ ID NO: 498, SEQ ID NO: 504, SEQ ID NO: 510, SEQ ID NO: 516, SEQ ID NO: 522, SEQ ID NO: 528, SEQ ID NO: 534, SEQ ID NO: 540, SEQ ID NO: 546, SEQ ID NO: 552, SEQ ID NO: 558, SEQ ID NO: 564, SEQ ID NO: 570, SEQ ID NO: 576, SEQ ID NO: 582, SEQ ID NO: 588, SEQ ID NO: 594, SEQ ID NO: 600, SEQ ID NO: 606, SEQ ID NO: 612, SEQ ID NO: 618, SEQ ID NO: 624, SEQ ID NO: 630, SEQ ID NO: 636, SEQ ID NO: 642, SEQ ID NO: 648, SEQ ID NO: 654, SEQ ID NO: 660, SEQ ID NO: 666, SEQ ID NO: 672, SEQ ID NO: 678, SEQ ID NO: 684, SEQ ID NO: 690, SEQ ID NO: 696, SEQ ID NO: 702, SEQ ID NO: 708, SEQ ID NO: 714, SEQ ID NO: 720, SEQ ID NO: 726, SEQ ID NO: 732, SEQ ID NO: 738, SEQ ID NO: 744, SEQ ID NO: 750, SEQ ID NO: 756, SEQ ID NO: 762, SEQ ID NO: 768, SEQ ID NO: 774, SEQ ID NO: 780, SEQ ID NO: 786, SEQ ID NO: 792, SEQ ID NO:

798, SEQ ID NO: 804, SEQ ID NO: 810, SEQ ID NO: 816, SEQ ID NO: 822, SEQ ID NO: 828, SEQ ID NO: 834, SEQ ID NO: 840, SEQ ID NO: 846, SEQ ID NO: 852, SEQ ID NO: 858, SEQ ID NO: 864, SEQ ID NO: 870, SEQ ID NO: 876, SEQ ID NO: 882, SEQ ID NO: 888, SEQ ID NO: 894, SEQ ID NO: 900, SEQ ID NO: 906, SEQ ID NO: 912, SEQ ID NO: 918, SEQ ID NO: 924, SEQ ID NO: 930, SEQ ID NO: 936, SEQ ID NO: 942, SEQ ID NO: 948, SEQ ID NO: 954, SEQ ID NO: 960, SEQ ID NO: 966, SEQ ID NO: 972, SEQ ID NO: 978, SEQ ID NO: 984, SEQ ID NO: 990, SEQ ID NO: 996, SEQ ID NO: 1002, SEQ ID NO: 1008, SEQ ID NO: 1014, SEQ ID NO: 1020, SEQ ID NO: 1026, SEQ ID NO: 1032, SEQ ID NO: 1038, SEQ ID NO: 1044, SEQ ID NO: 1050, SEQ ID NO: 1056, SEQ ID NO: 1062, SEQ ID NO: 1068, SEQ ID NO: 1074, SEQ ID NO: 1080, SEQ ID NO: 1086, SEQ ID NO: 1092, SEQ ID NO: 1098, SEQ ID NO: 1104, SEQ ID NO: 1110, SEQ ID NO: 1116, SEQ ID NO: 1122, SEQ ID NO: 1128, SEQ ID NO: 1134, SEQ ID NO: 1140, SEQ ID NO: 1146, SEQ ID NO: 1152, SEQ ID NO: 1158, SEQ ID NO: 1164, SEQ ID NO: 1170, SEQ ID NO: 1176, SEQ ID NO: 1182, SEQ ID NO: 1188, SEQ ID NO: 1194, SEQ ID NO: 1200, SEQ ID NO: 1206, SEQ ID NO: 1212, SEQ ID NO: 1218, SEQ ID NO: 1224, SEQ ID NO: 1230, SEQ ID NO: 1236, SEQ ID NO: 1242, SEQ ID NO: 1248, SEQ ID NO: 1254, SEQ ID NO: 1260, SEQ ID NO: 1266, SEQ ID NO: 1272, SEQ ID NO: 1278, SEQ ID NO: 1284, SEQ ID NO: 1290, SEQ ID NO: 1296, SEQ ID NO: 1302, SEQ ID NO: 1308, SEQ ID NO: 1314, SEQ ID NO: 1320, SEQ ID NO: 1326, SEQ ID NO: 1332, SEQ ID NO: 1338, SEQ ID NO: 1344, SEQ ID NO: 1350, SEQ ID NO: 1356, SEQ ID NO: 1362, SEQ ID NO: 1368, SEQ ID NO: 1374, SEQ ID NO: 1380, SEQ ID NO: 1386, SEQ ID NO: 1392, SEQ ID NO: 1398, SEQ ID NO: 1404, SEQ ID NO: 1410, SEQ ID NO: 1416, SEQ ID NO: 1422, SEQ ID NO: 1428, SEQ ID NO: 1434, SEQ ID NO: 1440, SEQ ID NO: 1446, SEQ ID NO: 1452, SEQ ID NO: 1458, SEQ ID NO: 1464, SEQ ID NO: 1470, SEQ ID NO: 1476, SEQ ID NO: 1482, SEQ ID NO: 1488, SEQ ID NO: 1494, SEQ ID NO: 1500, SEQ ID NO: 1506, SEQ ID NO: 1512, SEQ ID NO: 1518, SEQ ID NO: 1524, SEQ ID NO: 1598, SEQ ID NO: 1530, SEQ ID NO: 1536, SEQ ID NO: 1542, SEQ ID NO: 1548, SEQ ID NO: 1554, SEQ ID NO: 1560, SEQ ID NO: 1566, SEQ ID NO: 1572, SEQ ID NO: 1578, SEQ ID NO: 1584, or SEQ ID NO: 1590 as shown in FIGS. 3A, 3B, 3C, 3D, 3E, 3F, 3G, 3H, 3I, 3J, 3K, or 3L, and the HCDR1, HCDR2, HCDR3, LCDR1, LCDR2, and LCDR3 are from a same clone.

In some embodiments, an isolated antigen binding molecule that binds to human TIGIT comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 as shown in FIGS. 2A, 2B, 2C, 2D, 2E, 2F, 2G, 2H, 2I, 2J, 2K, 2L, 2M, 2N, 2O, 2P, 2Q or 2R.

In some embodiments, an isolated antigen binding molecule that binds to human TIGIT comprises a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 as shown in FIGS. 2A, 2B, 2C, 2D, 2E, 2F, 2G, 2H, 2I, 2J, 2K, 2L, 2M, 2N, 2O, 2P, 2Q or 2R.

In some embodiments, an isolated antigen binding molecule that binds to human TIGIT comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 as shown in FIGS. 2A, 2B, 2C, 2D, 2E, 2F, 2G, 2H, 2I, 2J, 2K, 2L, 2M, 2N, 2O, 2P, 2Q or 2R and a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 as shown in FIGS. 2A, 2B, 2C, 2D, 2E, 2F, 2G, 2H, 2I, 2J, 2K, 2L, 2M, 2N, 2O, 2P, 2Q or 2R.

In some embodiments, an isolated antibody comprises a heavy chain CDR1 comprising the amino acid sequence of any of one of the HCDR1s in SEQ ID NO: 397, SEQ ID NO: 403. SEQ ID NO: 409, SEQ ID NO: 415, SEQ ID NO: 421, SEQ ID NO: 427, SEQ ID NO: 433, SEQ ID NO: 439, SEQ ID NO: 445, SEQ ID NO: 451, SEQ ID NO: 457, SEQ ID NO: 463, SEQ ID NO: 469, SEQ ID NO: 475, SEQ ID NO: 481, SEQ ID NO: 487, SEQ ID NO: 493, SEQ ID NO: 499, SEQ ID NO: 505, SEQ ID NO: 511, SEQ ID NO: 517, SEQ ID NO: 523, SEQ ID NO: 529, SEQ ID NO: 535, SEQ ID NO: 541, SEQ ID NO: 547, SEQ ID NO: 553, SEQ ID NO: 559, SEQ ID NO: 565, SEQ ID NO: 571, SEQ ID NO: 577, SEQ ID NO: 583, SEQ ID NO: 589, SEQ ID NO: 595, SEQ ID NO: 601, SEQ ID NO: 607, SEQ ID NO: 613, SEQ ID NO: 619, SEQ ID NO: 625, SEQ ID NO: 631, SEQ ID NO: 637, SEQ ID NO: 643, SEQ ID NO: 649, SEQ ID NO: 655, SEQ ID NO: 661, SEQ ID NO: 667, SEQ ID NO: 673, SEQ ID NO: 679, SEQ ID NO: 685, SEQ ID NO: 691, SEQ ID NO: 697, SEQ ID NO: 703, SEQ ID NO: 709, SEQ ID NO: 715, SEQ ID NO: 721, SEQ ID NO: 727, SEQ ID NO: 733, SEQ ID NO: 739, SEQ ID NO: 745, SEQ ID NO: 751, SEQ ID NO: 757, SEQ ID NO: 763, SEQ ID NO: 769, SEQ ID NO: 775, SEQ ID NO: 781, SEQ ID NO: 787, SEQ ID NO: 793, SEQ ID NO: 799, SEQ ID NO: 805, SEQ ID NO: 811, SEQ ID NO: 817, SEQ ID NO: 823, SEQ ID NO: 829, SEQ ID NO: 835, SEQ ID NO: 841, SEQ ID NO: 847, SEQ ID NO: 853, SEQ ID NO: 859, SEQ ID NO: 865, SEQ ID NO: 871, SEQ ID NO: 877, SEQ ID NO: 883, SEQ ID NO: 889, SEQ ID NO: 895, SEQ ID NO: 901, SEQ ID NO: 907, SEQ ID NO: 913, SEQ ID NO: 919, SEQ ID NO: 925, SEQ ID NO: 931, SEQ ID NO: 937, SEQ ID NO: 943, SEQ ID NO: 949, SEQ ID NO: 955, SEQ ID NO: 961, SEQ ID NO: 967, SEQ ID NO: 973, SEQ ID NO: 979, SEQ ID NO: 985, SEQ ID NO: 991, SEQ ID NO: 997, SEQ ID NO: 1003, SEQ ID NO: 1009, SEQ ID NO: 1015, SEQ ID NO: 1021, SEQ ID NO: 1027, SEQ ID NO: 1033, SEQ ID NO: 1039, SEQ ID NO: 1045, SEQ ID NO: 1051, SEQ ID NO: 1057, SEQ ID NO: 1063, SEQ ID NO: 1069, SEQ ID NO: 1075, SEQ ID NO: 1081, SEQ ID NO: 1087, SEQ ID NO: 1093, SEQ ID NO: 1099, SEQ ID NO: 1105, SEQ ID NO: 1111, SEQ ID NO: 1117, SEQ ID NO: 1123, SEQ ID NO: 1129, SEQ ID NO: 1135, SEQ ID NO: 1141, SEQ ID NO: 1147, SEQ ID NO: 1153, SEQ ID NO: 1159, SEQ ID NO: 1165, SEQ ID NO: 1171, SEQ ID NO: 1177, SEQ ID NO: 1183, SEQ ID NO: 1189, SEQ ID NO: 1195, SEQ ID NO: 1201, SEQ ID NO: 1207, SEQ ID NO: 1213, SEQ ID NO: 1219, SEQ ID NO: 1225, SEQ ID NO: 1231, SEQ ID NO: 1237, SEQ ID NO: 1243, SEQ ID NO: 1249, SEQ ID NO: 1255, SEQ ID NO: 1261, SEQ ID NO: 1267, SEQ ID NO: 1273, SEQ ID NO: 1279, SEQ ID NO: 1285, SEQ ID NO: 1291, SEQ ID NO: 1297, SEQ ID NO: 1303, SEQ ID NO: 1309, SEQ ID NO: 1315, SEQ ID NO: 1321, SEQ ID NO: 1327, SEQ ID NO: 1333, SEQ ID NO: 1339, SEQ ID NO: 1345, SEQ ID NO: 1351, SEQ ID NO: 1357, SEQ ID NO: 1363, SEQ ID NO: 1369, SEQ ID NO: 1375, SEQ ID NO: 1381, SEQ ID NO: 1387, SEQ ID NO: 1393, SEQ ID NO: 1399, SEQ ID NO: 1405, SEQ ID NO: 1411, SEQ ID NO: 1417, SEQ ID NO: 1423, SEQ ID NO: 1429, SEQ ID NO: 1435, SEQ ID NO: 1441, SEQ ID NO: 1447, SEQ ID NO: 1453, SEQ ID NO: 1459, SEQ ID NO: 1465, SEQ ID NO: 1471, SEQ ID NO: 1477, SEQ ID NO: 1483, SEQ ID NO: 1489, SEQ ID NO: 1495, SEQ ID NO: 1501, SEQ ID NO: 1507, SEQ ID NO: 1513, SEQ ID NO: 1519, SEQ ID NO: 1593, SEQ ID NO: 1525 SEQ ID NO: 1531, SEQ ID NO: 1537, SEQ ID NO: 1543, SEQ ID NO: 1549, SEQ ID NO: 1555, SEQ ID NO: 1561, SEQ ID NO: 1567, SEQ ID NO: 1573, SEQ ID NO: 1579, or SEQ ID NO: 1585 as shown in FIGS. 3A, 3B, 3C, 3D, 3E, 3F, 3G, 3H, 3I, 3K, or 3L, a heavy chain CDR2 comprising the amino acid sequence of any one of the HCDR2s in SEQ ID NO: 398, SEQ ID NO: 404, SEQ ID NO: 410, SEQ ID NO: 416, SEQ ID NO: 422, SEQ ID NO: 428, SEQ ID NO: 434, SEQ ID NO: 440, SEQ ID NO: 446, SEQ ID NO: 452, SEQ ID NO: 458, SEQ ID NO: 464, SEQ ID NO: 470, SEQ ID NO: 476, SEQ ID NO: 482, SEQ ID NO: 488, SEQ ID NO: 494, SEQ ID NO: 500, SEQ ID NO: 506, SEQ ID NO: 512, SEQ ID NO: 518, SEQ ID NO: 524, SEQ ID NO: 530, SEQ ID NO: 536, SEQ ID NO: 542, SEQ ID NO: 548, SEQ ID NO: 554, SEQ ID NO: 560, SEQ ID NO: 566, SEQ ID NO: 572, SEQ ID NO: 578, SEQ ID NO: 584, SEQ ID NO: 590, SEQ ID NO: 596, SEQ ID NO: 602, SEQ ID NO: 608, SEQ ID NO: 614, SEQ ID NO: 620, SEQ ID NO: 626, SEQ ID NO: 632, SEQ ID NO: 638, SEQ ID NO: 644, SEQ ID NO: 650, SEQ ID NO: 656, SEQ ID NO: 662, SEQ ID NO: 668, SEQ ID NO: 674, SEQ ID NO: 680, SEQ ID NO: 686, SEQ ID NO: 692, SEQ ID NO: 698, SEQ ID NO: 704, SEQ ID NO: 710, SEQ ID NO: 716, SEQ ID NO: 722, SEQ ID NO: 728, SEQ ID NO: 734, SEQ ID NO: 740, SEQ ID NO: 746, SEQ ID NO: 752, SEQ ID NO: 758, SEQ ID NO: 764, SEQ ID NO: 770, SEQ ID NO: 776, SEQ ID NO: 782, SEQ ID NO: 788, SEQ ID NO: 794, SEQ ID NO: 800, SEQ ID NO: 806, SEQ ID NO: 812, SEQ ID NO: 818, SEQ ID NO: 824, SEQ ID NO: 830, SEQ ID NO: 836, SEQ ID NO: 842, SEQ ID NO: 848, SEQ ID NO: 854, SEQ ID NO: 860, SEQ ID NO: 866, SEQ ID NO: 872, SEQ ID NO: 878, SEQ ID NO: 884, SEQ ID NO: 890, SEQ ID NO: 896, SEQ ID NO: 902, SEQ ID NO: 908, SEQ ID NO: 914, SEQ ID NO: 920, SEQ ID NO: 926, SEQ ID NO: 932, SEQ ID NO: 938, SEQ ID NO: 944, SEQ ID NO: 950, SEQ ID NO: 956, SEQ ID NO: 962, SEQ ID NO: 968, SEQ ID NO: 974, SEQ ID NO: 980, SEQ ID NO: 986, SEQ ID NO: 992, SEQ ID NO: 998, SEQ ID NO: 1004, SEQ ID NO: 1010, SEQ ID NO: 1016, SEQ ID NO: 1022, SEQ ID NO: 1028, SEQ ID NO: 1034, SEQ ID NO: 1040, SEQ ID NO: 1046, SEQ ID NO: 1052, SEQ ID NO: 1058, SEQ ID NO: 1064, SEQ ID NO: 1070, SEQ ID NO: 1076, SEQ ID NO: 1082, SEQ ID NO: 1088, SEQ ID NO: 1094, SEQ ID NO: 1100, SEQ ID NO: 1106, SEQ ID NO: 1112, SEQ ID NO: 1118, SEQ ID NO: 1124, SEQ ID NO: 1130, SEQ ID NO: 1136, SEQ ID NO: 1142, SEQ ID NO: 1148, SEQ ID NO: 1154, SEQ ID NO: 1160, SEQ ID NO: 1166, SEQ ID NO: 1172, SEQ ID NO: 1178, SEQ ID NO: 1184, SEQ ID NO: 1190, SEQ ID NO: 1196, SEQ ID NO: 1202, SEQ ID NO: 1208, SEQ ID NO: 1214, SEQ ID NO: 1220, SEQ ID NO: 1226, SEQ ID NO: 1232, SEQ ID NO: 1238, SEQ ID NO: 1244, SEQ ID NO: 1250, SEQ ID NO: 1256, SEQ ID NO: 1262, SEQ ID NO: 1268, SEQ ID NO: 1274, SEQ ID NO: 1280, SEQ ID NO: 1286, SEQ ID NO: 1292, SEQ ID NO: 1298, SEQ ID NO: 1304, SEQ ID NO: 1310, SEQ ID NO: 1316, SEQ ID NO: 1322, SEQ ID NO: 1328, SEQ ID NO: 1334, SEQ ID NO: 1340, SEQ ID NO: 1346, SEQ ID NO: 1352, SEQ ID NO: 1358, SEQ ID NO: 1364, SEQ ID NO: 1370, SEQ ID NO: 1376, SEQ ID NO: 1382, SEQ ID NO: 1388, SEQ ID NO: 1394, SEQ ID NO: 1400, SEQ ID NO: 1406, SEQ ID NO: 1412, SEQ ID NO: 1418, SEQ ID NO: 1424, SEQ ID NO: 1430, SEQ ID NO: 1436, SEQ ID NO: 1442, SEQ ID NO: 1448, SEQ ID NO: 1454, SEQ ID NO: 1460, SEQ ID NO: 1466, SEQ ID NO: 1472, SEQ ID NO: 1478, SEQ ID NO: 1484, SEQ ID NO: 1490, SEQ ID NO: 1496, SEQ ID NO: 1502, SEQ ID NO: 1508, SEQ ID NO: 1514, SEQ ID NO: 1520, SEQ ID NO: 1594, SEQ ID NO: 1526, SEQ ID NO: 1532, SEQ ID NO: 1538, SEQ ID NO: 1544, SEQ ID NO: 1550, SEQ ID NO: 1556, SEQ ID NO: 1562, SEQ ID NO: 1568, SEQ ID NO: 1574, SEQ ID NO: 1580, or SEQ ID NO: 1586 as shown in FIGS. 3A, 3B, 3C, 3D, 3E, 3F, 3G, 3H, 3I, 3J, 3K, or 3L, a heavy chain CDR3 comprising the amino acid sequence of any one of the HCDR3s in SEQ ID NO: 399, SEQ ID NO: 405, SEQ ID NO: 411, SEQ ID NO: 417, SEQ ID NO: 423, SEQ ID NO: 429, SEQ ID NO: 435, SEQ ID NO: 441, SEQ ID NO: 447, SEQ ID NO: 453, SEQ ID NO: 459, SEQ ID NO: 465, SEQ ID NO: 471, SEQ ID NO: 477, SEQ ID NO: 483, SEQ ID NO: 489, SEQ ID NO: 495, SEQ ID NO: 501, SEQ ID NO: 507, SEQ ID NO: 513, SEQ ID NO: 519, SEQ ID NO: 525, SEQ ID NO: 531, SEQ ID NO: 537, SEQ ID NO: 543, SEQ ID NO: 549, SEQ ID NO: 555, SEQ ID NO: 561, SEQ ID NO: 567, SEQ ID NO: 573, SEQ ID NO: 579, SEQ ID NO: 585, SEQ ID NO: 591, SEQ ID NO: 597, SEQ ID NO: 603, SEQ ID NO: 609, SEQ ID NO: 615, SEQ ID NO: 621, SEQ ID NO: 627, SEQ ID NO: 633, SEQ ID NO: 639, SEQ ID NO: 645, SEQ ID NO: 651, SEQ ID NO: 657, SEQ ID NO: 663, SEQ ID NO: 669, SEQ ID NO: 675, SEQ ID NO: 681, SEQ ID NO: 687, SEQ ID NO: 693, SEQ ID NO: 699, SEQ ID NO: 705, SEQ ID NO: 711, SEQ ID NO: 717, SEQ ID NO: 723, SEQ ID NO: 729, SEQ ID NO: 735, SEQ ID NO: 741, SEQ ID NO: 747, SEQ ID NO: 753, SEQ ID NO: 759, SEQ ID NO: 765, SEQ ID NO: 771, SEQ ID NO: 777, SEQ ID NO: 783, SEQ ID NO: 789, SEQ ID NO: 795, SEQ ID NO: 801, SEQ ID NO: 807, SEQ ID NO: 813, SEQ ID NO: 819, SEQ ID NO: 825, SEQ ID NO: 831, SEQ ID NO: 837, SEQ ID NO: 843, SEQ ID NO: 849, SEQ ID NO: 855, SEQ ID NO: 861, SEQ ID NO: 867, SEQ ID NO: 873, SEQ ID NO: 879, SEQ ID NO: 885, SEQ ID NO: 891, SEQ ID NO: 897, SEQ ID NO: 903, SEQ ID NO: 909, SEQ ID NO: 915, SEQ ID NO: 921, SEQ ID NO: 927, SEQ ID NO: 933, SEQ ID NO: 939, SEQ ID NO: 945, SEQ ID NO: 951, SEQ ID NO: 957, SEQ ID NO: 963, SEQ ID NO: 969, SEQ ID NO: 975, SEQ ID NO: 981, SEQ ID NO: 987, SEQ ID NO: 993, SEQ ID NO: 999, SEQ ID NO: 1005, SEQ ID NO: 1011, SEQ ID NO: 1017, SEQ ID NO: 1023, SEQ ID NO: 1029, SEQ ID NO: 1035, SEQ ID NO: 1041, SEQ ID NO: 1047, SEQ ID NO: 1053, SEQ ID NO: 1059, SEQ ID NO: 1065, SEQ ID NO: 1071, SEQ ID NO: 1077, SEQ ID NO: 1083, SEQ ID NO: 1089, SEQ ID NO: 1095, SEQ ID NO: 1101, SEQ ID NO: 1107, SEQ ID NO: 1113, SEQ ID NO: 1119, SEQ ID NO: 1125, SEQ ID NO: 1131, SEQ ID NO: 1137, SEQ ID NO: 1143, SEQ ID NO: 1149, SEQ ID NO: 1155, SEQ ID NO: 1161, SEQ ID NO: 1167, SEQ ID NO: 1173, SEQ ID NO: 1179, SEQ ID NO: 1185, SEQ ID NO: 1191, SEQ ID NO: 1197, SEQ ID NO: 1203, SEQ ID NO: 1209, SEQ ID NO: 1215, SEQ ID NO: 1221, SEQ ID NO: 1227, SEQ ID NO: 1233, SEQ ID NO: 1239, SEQ ID NO: 1245, SEQ ID NO: 1251, SEQ ID NO: 1257, SEQ ID NO: 1263, SEQ ID NO: 1269, SEQ ID NO: 1275, SEQ ID NO: 1281, SEQ ID NO: 1287, SEQ ID NO: 1293, SEQ ID NO: 1299, SEQ ID NO: 1305, SEQ ID NO: 1311, SEQ ID NO: 1317, SEQ ID NO: 1323, SEQ ID NO: 1329, SEQ ID NO: 1335, SEQ ID NO: 1341, SEQ ID NO: 1347, SEQ ID NO: 1353, SEQ ID NO: 1359, SEQ ID NO: 1365, SEQ ID NO: 1371, SEQ ID NO: 1377, SEQ ID NO: 1383, SEQ ID NO: 1389, SEQ ID NO: 1395, SEQ ID NO: 1401, SEQ ID NO: 1407, SEQ ID NO: 1413, SEQ ID NO: 1419, SEQ ID NO: 1425, SEQ ID NO: 1431, SEQ ID NO: 1437, SEQ ID NO: 1443, SEQ ID NO: 1449, SEQ ID NO: 1455, SEQ ID NO: 1461, SEQ ID NO: 1467, SEQ ID NO: 1473, SEQ ID NO: 1479, SEQ ID NO: 1485, SEQ ID NO: 1491, SEQ ID NO: 1497, SEQ ID NO: 1503, SEQ ID NO: 1509, SEQ ID NO: 1515, SEQ ID NO: 1521, SEQ ID NO: 1595, SEQ ID NO: 1527, SEQ ID NO: 1533, SEQ ID NO: 1539, SEQ ID NO: 1545, SEQ ID NO: 1551, SEQ ID NO: 1557, SEQ ID NO: 1563, SEQ ID NO: 1569, SEQ ID NO: 1575, SEQ ID NO: 1581, or SEQ ID NO: 1587 as shown in FIGS. 3A, 3B, 3C, 3D, 3E, 3F, 3G, 3H, 3I, 3J, 3K, or 3L, a light chain CDR1 comprising the amino acid sequence of any one of the LCDR1s in SEQ ID NO: 400, SEQ ID NO: 406, SEQ ID NO: 412, SEQ ID NO: 418, SEQ ID NO: 424, SEQ ID NO: 430, SEQ ID NO: 436, SEQ ID NO: 442, SEQ ID NO: 448, SEQ ID NO: 454, SEQ ID NO: 460, SEQ ID NO: 466, SEQ ID NO: 472, SEQ ID NO: 478, SEQ ID NO: 484, SEQ ID NO: 490, SEQ ID NO: 496, SEQ ID NO: 502, SEQ ID NO: 508, SEQ ID NO: 514, SEQ ID NO: 520, SEQ ID NO: 526, SEQ ID NO: 532, SEQ ID NO: 538, SEQ ID NO: 544, SEQ ID NO: 550, SEQ ID NO: 556, SEQ ID NO: 562, SEQ ID NO: 568, SEQ ID NO: 574, SEQ ID NO: 580, SEQ ID NO: 586, SEQ ID NO: 592, SEQ ID NO: 598, SEQ ID NO: 604, SEQ ID NO: 610, SEQ ID NO: 616, SEQ ID NO: 622, SEQ ID NO: 628, SEQ ID NO: 634, SEQ ID NO: 640, SEQ ID NO: 646, SEQ ID NO: 652, SEQ ID NO: 658, SEQ ID NO: 664, SEQ ID NO: 670, SEQ ID NO: 676, SEQ ID NO: 682, SEQ ID NO: 688, SEQ ID NO: 694, SEQ ID NO: 700, SEQ ID NO: 706, SEQ ID NO: 712, SEQ ID NO: 718, SEQ ID NO: 724, SEQ ID NO: 730, SEQ ID NO: 736, SEQ ID NO: 742, SEQ ID NO: 748, SEQ ID NO: 754, SEQ ID NO: 760, SEQ ID NO: 766, SEQ ID NO: 772, SEQ ID NO: 778, SEQ ID NO: 784, SEQ ID NO: 790, SEQ ID NO: 796, SEQ ID NO: 802, SEQ ID NO: 808, SEQ ID NO: 814, SEQ ID NO: 820, SEQ ID NO: 826, SEQ ID NO: 832, SEQ ID NO: 838, SEQ ID NO: 844, SEQ ID NO: 850, SEQ ID NO: 856, SEQ ID NO: 862, SEQ ID NO: 868, SEQ ID NO: 874, SEQ ID NO: 880, SEQ ID NO: 886, SEQ ID NO: 892, SEQ ID NO: 898, SEQ ID NO: 904, SEQ ID NO: 910, SEQ ID NO: 916, SEQ ID NO: 922, SEQ ID NO: 928, SEQ ID NO: 934, SEQ ID NO: 940, SEQ ID NO: 946, SEQ ID NO: 952, SEQ ID NO: 958, SEQ ID NO: 964, SEQ ID NO: 970, SEQ ID NO: 976, SEQ ID NO: 982, SEQ ID NO: 988, SEQ ID NO: 994, SEQ ID NO: 1000, SEQ ID NO: 1006, SEQ ID NO: 1012, SEQ ID NO: 1018, SEQ ID NO: 1024, SEQ ID NO: 1030, SEQ ID NO: 1036, SEQ ID NO: 1042, SEQ ID NO: 1048, SEQ ID NO: 1054, SEQ ID NO: 1060, SEQ ID NO: 1066, SEQ ID NO: 1072, SEQ ID NO: 1078, SEQ ID NO: 1084, SEQ ID NO: 1090, SEQ ID NO: 1096, SEQ ID NO: 1102, SEQ ID NO: 1108, SEQ ID NO: 1114, SEQ ID NO: 1120, SEQ ID NO: 1126, SEQ ID NO: 1132, SEQ ID NO: 1138, SEQ ID NO: 1144, SEQ ID NO: 1150, SEQ ID NO: 1156, SEQ ID NO: 1162, SEQ ID NO: 1168, SEQ ID NO: 1174, SEQ ID NO: 1180, SEQ ID NO: 1186, SEQ ID NO: 1192, SEQ ID NO: 1198, SEQ ID NO: 1204, SEQ ID NO: 1210, SEQ ID NO: 1216, SEQ ID NO: 1222, SEQ ID NO: 1228, SEQ ID NO: 1234, SEQ ID NO: 1240, SEQ ID NO: 1246, SEQ ID NO: 1252, SEQ ID NO: 1258, SEQ ID NO: 1264, SEQ ID NO: 1270, SEQ ID NO: 1276, SEQ ID NO: 1282, SEQ ID NO: 1288, SEQ ID NO: 1294, SEQ ID NO: 1300, SEQ ID NO: 1306, SEQ ID NO: 1312, SEQ ID NO: 1318, SEQ ID NO: 1324, SEQ ID NO: 1330, SEQ ID NO: 1336, SEQ ID NO: 1342, SEQ ID NO: 1348, SEQ ID NO: 1354, SEQ ID NO: 1360, SEQ ID NO: 1366, SEQ ID NO: 1372, SEQ ID NO: 1378, SEQ ID NO: 1384, SEQ ID NO: 1390, SEQ ID NO: 1396, SEQ ID NO: 1402, SEQ ID NO: 1408, SEQ ID NO: 1414, SEQ ID NO: 1420, SEQ ID NO: 1426, SEQ ID NO: 1432, SEQ ID NO: 1438, SEQ ID NO: 1444, SEQ ID NO: 1450. SEQ ID NO: 1456, SEQ ID NO: 1462, SEQ ID NO: 1468, SEQ ID NO: 1474, SEQ ID NO: 1480, SEQ ID NO: 1486, SEQ ID NO: 1492, SEQ ID NO: 1498, SEQ ID NO: 1504, SEQ ID NO: 1510, SEQ ID NO: 1516, SEQ ID NO: 1522, SEQ ID NO: 1596, SEQ ID NO: 1528, SEQ ID NO: 1534, SEQ ID NO: 1540, SEQ ID NO: 1546, SEQ ID NO: 1552, SEQ ID NO: 1558, SEQ ID NO: 1564, SEQ ID NO: 1570, SEQ ID NO: 1576, SEQ ID NO: 1582, or SEQ ID NO: 1588 as shown in FIGS. 3A, 3B, 3C, 3D, 3E, 3F, 3G, 3H, 3I, 3J, 3K, or 3L, a light chain CDR2 comprising the amino acid sequence of any one of the LCDR2s in SEQ ID NO: 401, SEQ ID NO: 407, SEQ ID NO: 413, SEQ ID NO: 419, SEQ ID NO: 425, SEQ ID NO: 431, SEQ ID NO: 437, SEQ ID NO: 443, SEQ ID NO: 449, SEQ ID NO: 455, SEQ ID NO: 461, SEQ ID NO: 467, SEQ ID NO: 473, SEQ ID NO: 479, SEQ ID NO: 485, SEQ ID NO: 491, SEQ ID NO: 497, SEQ ID NO: 503, SEQ ID NO: 509, SEQ ID NO: 515, SEQ ID NO: 521, SEQ ID NO: 527, SEQ ID NO: 533, SEQ ID NO: 539, SEQ ID NO: 545, SEQ ID NO: 551, SEQ ID NO: 557, SEQ ID NO: 563, SEQ ID NO: 569, SEQ ID NO: 575, SEQ ID NO: 581, SEQ ID NO: 587, SEQ ID NO: 593, SEQ ID NO: 599, SEQ ID NO: 605, SEQ ID NO: 611, SEQ ID NO: 617, SEQ ID NO: 623, SEQ ID NO: 629, SEQ ID NO: 635, SEQ ID NO: 641, SEQ ID NO: 647, SEQ ID NO: 653, SEQ ID NO: 659, SEQ ID NO: 665, SEQ ID NO: 671, SEQ ID NO: 677, SEQ ID NO: 683, SEQ ID NO: 689, SEQ ID NO: 695, SEQ ID NO: 701, SEQ ID NO: 707, SEQ ID NO: 713, SEQ ID NO: 719, SEQ ID NO: 725, SEQ ID NO: 731, SEQ ID NO: 737, SEQ ID NO: 743, SEQ ID NO: 749, SEQ ID NO: 755, SEQ ID NO: 761, SEQ ID NO: 767, SEQ ID NO: 773, SEQ ID NO: 779, SEQ ID NO: 785, SEQ ID NO: 791, SEQ ID NO: 797, SEQ ID NO: 803, SEQ ID NO: 809, SEQ ID NO: 815, SEQ ID NO: 821, SEQ ID NO: 827, SEQ ID NO: 833, SEQ ID NO: 839, SEQ ID NO: 845, SEQ ID NO: 851, SEQ ID NO: 857, SEQ ID NO: 863, SEQ ID NO: 869, SEQ ID NO: 875, SEQ ID NO: 881, SEQ ID NO: 887, SEQ ID NO: 893, SEQ ID NO: 899, SEQ ID NO: 905, SEQ ID NO: 911, SEQ ID NO: 917, SEQ ID NO: 923, SEQ ID NO: 929, SEQ ID NO: 935, SEQ ID NO: 941, SEQ ID NO: 947, SEQ ID NO: 953, SEQ ID NO: 959, SEQ ID NO: 965, SEQ ID NO: 971, SEQ ID NO: 977, SEQ ID NO: 983, SEQ ID NO: 989, SEQ ID NO: 995, SEQ ID NO: 1001, SEQ ID NO: 1007, SEQ ID NO: 1013, SEQ ID NO: 1019, SEQ ID NO: 1025, SEQ ID NO: 1031, SEQ ID NO: 1037, SEQ ID NO: 1043, SEQ ID NO: 1049, SEQ ID NO: 1055, SEQ ID NO: 1061, SEQ ID NO: 1067, SEQ ID NO: 1073, SEQ ID NO: 1079, SEQ ID NO: 1085, SEQ ID NO: 1091, SEQ ID NO: 1097, SEQ ID NO: 1103, SEQ ID NO: 1109, SEQ ID NO: 1115, SEQ ID NO: 1121, SEQ ID NO: 1127, SEQ ID NO: 1133, SEQ ID NO: 1139, SEQ ID NO: 1145, SEQ ID NO: 1151, SEQ ID NO: 1157, SEQ ID NO: 1163, SEQ ID NO: 1169, SEQ ID NO: 1175, SEQ ID NO: 1181, SEQ ID NO: 1187, SEQ ID NO: 1193, SEQ ID NO: 1199, SEQ ID NO: 1205, SEQ ID NO: 1211, SEQ ID NO: 1217, SEQ ID NO: 1223, SEQ ID NO: 1229, SEQ ID NO: 1235, SEQ ID NO: 1241, SEQ ID NO: 1247, SEQ ID NO: 1253, SEQ ID NO: 1259, SEQ ID NO: 1265, SEQ ID NO: 1271, SEQ ID NO: 1277, SEQ ID NO: 1283, SEQ ID NO: 1289, SEQ ID NO: 1295, SEQ ID NO: 1301, SEQ ID NO: 1307, SEQ ID NO: 1313, SEQ ID NO: 1319, SEQ ID NO: 1325, SEQ ID NO: 1331, SEQ ID NO: 1337, SEQ ID NO: 1343, SEQ ID NO: 1349, SEQ ID NO: 1355, SEQ ID NO: 1361, SEQ ID NO: 1367, SEQ ID NO: 1373, SEQ ID NO: 1379, SEQ ID NO: 1385, SEQ ID NO: 1391, SEQ ID NO: 1397, SEQ ID NO: 1403, SEQ ID NO: 1409, SEQ ID NO: 1415, SEQ ID NO: 1421, SEQ ID NO: 1427, SEQ ID NO: 1433, SEQ ID NO: 1439, SEQ ID NO: 1445, SEQ ID NO: 1451, SEQ ID NO: 1457, SEQ ID NO: 1463, SEQ ID NO: 1469, SEQ ID NO: 1475, SEQ ID NO: 1481, SEQ ID NO: 1487, SEQ ID NO: 1493, SEQ ID NO: 1499, SEQ ID NO: 1505, SEQ ID NO:

1511, SEQ ID NO: 1517, SEQ ID NO: 1523, SEQ ID NO: 1597, SEQ ID NO: 1529, SEQ ID NO: 1535, SEQ ID NO: 1541, SEQ ID NO: 1547, SEQ ID NO: 1553, SEQ ID NO: 1559, SEQ ID NO: 1565, SEQ ID NO: 1571, SEQ ID NO: 1577, SEQ ID NO: 1583, or SEQ ID NO: 1589 as shown in FIGS. 3A, 3B, 3C, 3D, 3E, 3F, 3G, 3H, 3I, 3J, 3K, or 3L, and a light chain CDR3 comprising the amino acid sequence of any one of the LCDR3s in SEQ ID NO: 402, SEQ ID NO: 408, SEQ ID NO: 414, SEQ ID NO: 420, SEQ ID NO: 426, SEQ ID NO: 432, SEQ ID NO: 438, SEQ ID NO: 444, SEQ ID NO: 450, SEQ ID NO: 456, SEQ ID NO: 462, SEQ ID NO: 468, SEQ ID NO: 474, SEQ ID NO: 480, SEQ ID NO: 486, SEQ ID NO: 492, SEQ ID NO: 498, SEQ ID NO: 504, SEQ ID NO: 510, SEQ ID NO: 516, SEQ ID NO: 522, SEQ ID NO: 528, SEQ ID NO: 534, SEQ ID NO: 540, SEQ ID NO: 546, SEQ ID NO: 552, SEQ ID NO: 558, SEQ ID NO: 564, SEQ ID NO: 570, SEQ ID NO: 576, SEQ ID NO: 582, SEQ ID NO: 588, SEQ ID NO: 594, SEQ ID NO: 600, SEQ ID NO: 606, SEQ ID NO: 612, SEQ ID NO: 618, SEQ ID NO: 624, SEQ ID NO: 630, SEQ ID NO: 636, SEQ ID NO: 642, SEQ ID NO: 648, SEQ ID NO: 654, SEQ ID NO: 660, SEQ ID NO: 666, SEQ ID NO: 672, SEQ ID NO: 678, SEQ ID NO: 684, SEQ ID NO: 690, SEQ ID NO: 696, SEQ ID NO: 702, SEQ ID NO: 708, SEQ ID NO: 714, SEQ ID NO: 720, SEQ ID NO: 726, SEQ ID NO: 732, SEQ ID NO: 738, SEQ ID NO: 744, SEQ ID NO: 750, SEQ ID NO: 756, SEQ ID NO: 762, SEQ ID NO: 768, SEQ ID NO: 774, SEQ ID NO: 780, SEQ ID NO: 786, SEQ ID NO: 792, SEQ ID NO: 798, SEQ ID NO: 804, SEQ ID NO: 810, SEQ ID NO: 816, SEQ ID NO: 822, SEQ ID NO: 828, SEQ ID NO: 834, SEQ ID NO: 840, SEQ ID NO: 846, SEQ ID NO: 852, SEQ ID NO: 858, SEQ ID NO: 864, SEQ ID NO: 870, SEQ ID NO: 876, SEQ ID NO: 882, SEQ ID NO: 888, SEQ ID NO: 894, SEQ ID NO: 900, SEQ ID NO: 906, SEQ ID NO: 912, SEQ ID NO: 918, SEQ ID NO: 924, SEQ ID NO: 930, SEQ ID NO: 936, SEQ ID NO: 942, SEQ ID NO: 948, SEQ ID NO: 954, SEQ ID NO: 960, SEQ ID NO: 966, SEQ ID NO: 972, SEQ ID NO: 978, SEQ ID NO: 984, SEQ ID NO: 990, SEQ ID NO: 996, SEQ ID NO: 1002, SEQ ID NO: 1008, SEQ ID NO: 1014, SEQ ID NO: 1020, SEQ ID NO: 1026, SEQ ID NO: 1032, SEQ ID NO: 1038, SEQ ID NO: 1044, SEQ ID NO: 1050, SEQ ID NO: 1056, SEQ ID NO: 1062, SEQ ID NO: 1068, SEQ ID NO: 1074, SEQ ID NO: 1080, SEQ ID NO: 1086, SEQ ID NO: 1092, SEQ ID NO: 1098, SEQ ID NO: 1104, SEQ ID NO: 1110, SEQ ID NO: 1116, SEQ ID NO: 1122, SEQ ID NO: 1128, SEQ ID NO: 1134, SEQ ID NO: 1140, SEQ ID NO: 1146, SEQ ID NO: 1152, SEQ ID NO: 1158, SEQ ID NO: 1164, SEQ ID NO: 1170, SEQ ID NO: 1176, SEQ ID NO: 1182, SEQ ID NO: 1188, SEQ ID NO: 1194, SEQ ID NO: 1200, SEQ ID NO: 1206, SEQ ID NO: 1212, SEQ ID NO: 1218, SEQ ID NO: 1224, SEQ ID NO: 1230, SEQ ID NO: 1236, SEQ ID NO: 1242, SEQ ID NO: 1248, SEQ ID NO: 1254, SEQ ID NO: 1260, SEQ ID NO: 1266, SEQ ID NO: 1272, SEQ ID NO: 1278, SEQ ID NO: 1284, SEQ ID NO: 1290, SEQ ID NO: 1296, SEQ ID NO: 1302, SEQ ID NO: 1308, SEQ ID NO: 1314, SEQ ID NO: 1320, SEQ ID NO: 1326, SEQ ID NO: 1332, SEQ ID NO: 1338, SEQ ID NO: 1344, SEQ ID NO: 1350, SEQ ID NO: 1356, SEQ ID NO: 1362, SEQ ID NO: 1368, SEQ ID NO: 1374, SEQ ID NO: 1380, SEQ ID NO: 1386, SEQ ID NO: 1392, SEQ ID NO: 1398, SEQ ID NO: 1404, SEQ ID NO: 1410, SEQ ID NO: 1416, SEQ ID NO: 1422, SEQ ID NO: 1428, SEQ ID NO: 1434, SEQ ID NO: 1440, SEQ ID NO: 1446, SEQ ID NO: 1452, SEQ ID NO: 1458, SEQ ID NO: 1464, SEQ ID NO: 1470, SEQ ID NO: 1476, SEQ ID NO: 1482, SEQ ID NO: 1488, SEQ ID NO: 1494, SEQ ID NO: 1500, SEQ ID NO: 1506, SEQ ID NO: 1512, SEQ ID NO: 1518, SEQ ID NO: 1524, SEQ ID NO: 1598, SEQ ID NO: 1530, SEQ ID NO: 1536, SEQ ID NO: 1542, SEQ ID NO: 1548, SEQ ID NO: 1554, SEQ ID NO: 1560, SEQ ID NO: 1566, SEQ ID NO: 1572, SEQ ID NO: 1578, SEQ ID NO: 1584, or SEQ ID NO: 1590 in FIGS. 3A, 3B, 3C, 3D, 3E, 3F, 3G, 3H, 3I, 3J, 3K, or 3L.

In some embodiments, an isolated antibody comprises a heavy chain CDR1 comprising the amino acid sequence of any of one of the HCDR1s in SEQ ID NO: 397, SEQ ID NO: 403. SEQ ID NO: 409, SEQ ID NO: 415, SEQ ID NO: 421, SEQ ID NO: 427, SEQ ID NO: 433, SEQ ID NO: 439, SEQ ID NO: 445, SEQ ID NO: 451, SEQ ID NO: 457, SEQ ID NO: 463, SEQ ID NO: 469, SEQ ID NO: 475, SEQ ID NO: 481, SEQ ID NO: 487, SEQ ID NO: 493, SEQ ID NO: 499, SEQ ID NO: 505, SEQ ID NO: 511, SEQ ID NO: 517, SEQ ID NO: 523, SEQ ID NO: 529, SEQ ID NO: 535, SEQ ID NO: 541, SEQ ID NO: 547, SEQ ID NO: 553, SEQ ID NO: 559, SEQ ID NO: 565, SEQ ID NO: 571, SEQ ID NO: 577, SEQ ID NO: 583, SEQ ID NO: 589, SEQ ID NO: 595, SEQ ID NO: 601, SEQ ID NO: 607, SEQ ID NO: 613, SEQ ID NO: 619, SEQ ID NO: 625, SEQ ID NO: 631, SEQ ID NO: 637, SEQ ID NO: 643, SEQ ID NO: 649, SEQ ID NO: 655, SEQ ID NO: 661, SEQ ID NO: 667, SEQ ID NO: 673, SEQ ID NO: 679, SEQ ID NO: 685, SEQ ID NO: 691, SEQ ID NO: 697, SEQ ID NO: 703, SEQ ID NO: 709, SEQ ID NO: 715, SEQ ID NO: 721, SEQ ID NO: 727, SEQ ID NO: 733, SEQ ID NO: 739, SEQ ID NO: 745, SEQ ID NO: 751, SEQ ID NO: 757, SEQ ID NO: 763, SEQ ID NO: 769, SEQ ID NO: 775, SEQ ID NO: 781, SEQ ID NO: 787, SEQ ID NO: 793, SEQ ID NO: 799, SEQ ID NO: 805, SEQ ID NO: 811, SEQ ID NO: 817, SEQ ID NO: 823, SEQ ID NO: 829, SEQ ID NO: 835, SEQ ID NO: 841, SEQ ID NO: 847, SEQ ID NO: 853, SEQ ID NO: 859, SEQ ID NO: 865, SEQ ID NO: 871, SEQ ID NO: 877, SEQ ID NO: 883, SEQ ID NO: 889, SEQ ID NO: 895, SEQ ID NO: 901, SEQ ID NO: 907, SEQ ID NO: 913, SEQ ID NO: 919, SEQ ID NO: 925, SEQ ID NO: 931, SEQ ID NO: 937, SEQ ID NO: 943, SEQ ID NO: 949, SEQ ID NO: 955, SEQ ID NO: 961, SEQ ID NO: 967, SEQ ID NO: 973, SEQ ID NO: 979, SEQ ID NO: 985, SEQ ID NO: 991, SEQ ID NO: 997, SEQ ID NO: 1003, SEQ ID NO: 1009, SEQ ID NO: 1015, SEQ ID NO: 1021, SEQ ID NO: 1027, SEQ ID NO: 1033, SEQ ID NO: 1039, SEQ ID NO: 1045, SEQ ID NO: 1051, SEQ ID NO: 1057, SEQ ID NO: 1063, SEQ ID NO: 1069, SEQ ID NO: 1075, SEQ ID NO: 1081, SEQ ID NO: 1087, SEQ ID NO: 1093, SEQ ID NO: 1099, SEQ ID NO: 1105, SEQ ID NO: 1111, SEQ ID NO: 1117, SEQ ID NO: 1123, SEQ ID NO: 1129, SEQ ID NO: 1135, SEQ ID NO: 1141, SEQ ID NO: 1147, SEQ ID NO: 1153, SEQ ID NO: 1159, SEQ ID NO: 1165, SEQ ID NO: 1171, SEQ ID NO: 1177, SEQ ID NO: 1183, SEQ ID NO: 1189, SEQ ID NO: 1195, SEQ ID NO: 1201, SEQ ID NO: 1207, SEQ ID NO: 1213, SEQ ID NO: 1219, SEQ ID NO: 1225, SEQ ID NO: 1231, SEQ ID NO: 1237, SEQ ID NO: 1243, SEQ ID NO: 1249, SEQ ID NO: 1255, SEQ ID NO: 1261, SEQ ID NO: 1267, SEQ ID NO: 1273, SEQ ID NO: 1279, SEQ ID NO: 1285, SEQ ID NO: 1291, SEQ ID NO: 1297, SEQ ID NO: 1303, SEQ ID NO: 1309, SEQ ID NO: 1315, SEQ ID NO: 1321, SEQ ID NO: 1327, SEQ ID NO: 1333, SEQ ID NO: 1339, SEQ ID NO: 1345, SEQ ID NO: 1351, SEQ ID NO: 1357, SEQ ID NO: 1363, SEQ ID NO: 1369, SEQ ID NO: 1375, SEQ ID NO: 1381, SEQ ID NO: 1387, SEQ ID NO: 1393, SEQ ID NO: 1399, SEQ ID NO: 1405, SEQ ID NO: 1411, SEQ ID NO: 1417, SEQ ID NO: 1423, SEQ ID NO: 1429, SEQ ID NO: 1435, SEQ ID NO: 1441, SEQ ID NO: 1447, SEQ ID NO: 1453, SEQ ID NO: 1459, SEQ ID NO: 1465, SEQ ID NO: 1471, SEQ ID NO: 1477, SEQ ID NO: 1483, SEQ ID NO: 1489, SEQ ID NO: 1495, SEQ ID NO: 1501, SEQ ID NO: 1507, SEQ ID NO: 1513, SEQ ID NO: 1519, SEQ ID NO: 1593, SEQ ID NO: 1525 SEQ ID NO: 1531, SEQ ID NO: 1537, SEQ ID NO: 1543, SEQ ID NO: 1549, SEQ ID NO: 1555, SEQ ID NO: 1561, SEQ ID NO: 1567, SEQ ID NO: 1573, SEQ ID NO: 1579, or SEQ ID NO: 1585 as shown in FIGS. 3A, 3B, 3C, 3D, 3E, 3F, 3G, 3H, 3I, 3J, 3K, or 3L, a heavy chain CDR2 comprising the amino acid sequence of any one of the HCDR2s in SEQ ID NO: 398, SEQ ID NO: 404, SEQ ID NO: 410, SEQ ID NO: 416, SEQ ID NO: 422, SEQ ID NO: 428, SEQ ID NO: 434, SEQ ID NO: 440, SEQ ID NO: 446, SEQ ID NO: 452, SEQ ID NO: 458, SEQ ID NO: 464, SEQ ID NO: 470, SEQ ID NO: 476, SEQ ID NO: 482, SEQ ID NO: 488, SEQ ID NO: 494, SEQ ID NO: 500, SEQ ID NO: 506, SEQ ID NO: 512, SEQ ID NO: 518, SEQ ID NO: 524, SEQ ID NO: 530, SEQ ID NO: 536, SEQ ID NO: 542, SEQ ID NO: 548, SEQ ID NO: 554, SEQ ID NO: 560, SEQ ID NO: 566, SEQ ID NO: 572, SEQ ID NO: 578, SEQ ID NO: 584, SEQ ID NO: 590, SEQ ID NO: 596, SEQ ID NO: 602, SEQ ID NO: 608, SEQ ID NO: 614, SEQ ID NO: 620, SEQ ID NO: 626, SEQ ID NO: 632, SEQ ID NO: 638, SEQ ID NO: 644, SEQ ID NO: 650, SEQ ID NO: 656, SEQ ID NO: 662, SEQ ID NO: 668, SEQ ID NO: 674, SEQ ID NO: 680, SEQ ID NO: 686, SEQ ID NO: 692, SEQ ID NO: 698, SEQ ID NO: 704, SEQ ID NO: 710, SEQ ID NO: 716, SEQ ID NO: 722, SEQ ID NO: 728, SEQ ID NO: 734, SEQ ID NO: 740, SEQ ID NO: 746, SEQ ID NO: 752, SEQ ID NO: 758, SEQ ID NO: 764, SEQ ID NO: 770, SEQ ID NO: 776, SEQ ID NO: 782, SEQ ID NO: 788, SEQ ID NO: 794, SEQ ID NO: 800, SEQ ID NO: 806, SEQ ID NO: 812, SEQ ID NO: 818, SEQ ID NO: 824, SEQ ID NO: 830, SEQ ID NO: 836, SEQ ID NO: 842, SEQ ID NO: 848, SEQ ID NO: 854, SEQ ID NO: 860, SEQ ID NO: 866, SEQ ID NO: 872, SEQ ID NO: 878, SEQ ID NO: 884, SEQ ID NO: 890, SEQ ID NO: 896, SEQ ID NO: 902, SEQ ID NO: 908, SEQ ID NO: 914, SEQ ID NO: 920, SEQ ID NO: 926, SEQ ID NO: 932, SEQ ID NO: 938, SEQ ID NO: 944, SEQ ID NO: 950, SEQ ID NO: 956, SEQ ID NO: 962, SEQ ID NO: 968, SEQ ID NO: 974, SEQ ID NO: 980, SEQ ID NO: 986, SEQ ID NO: 992, SEQ ID NO: 998, SEQ ID NO: 1004, SEQ ID NO: 1010, SEQ ID NO: 1016, SEQ ID NO: 1022, SEQ ID NO: 1028, SEQ ID NO: 1034, SEQ ID NO: 1040, SEQ ID NO: 1046, SEQ ID NO: 1052, SEQ ID NO: 1058, SEQ ID NO: 1064, SEQ ID NO: 1070, SEQ ID NO: 1076, SEQ ID NO: 1082, SEQ ID NO: 1088, SEQ ID NO: 1094, SEQ ID NO: 1100, SEQ ID NO: 1106, SEQ ID NO: 1112, SEQ ID NO: 1118, SEQ ID NO: 1124, SEQ ID NO: 1130, SEQ ID NO: 1136, SEQ ID NO: 1142, SEQ ID NO: 1148, SEQ ID NO: 1154, SEQ ID NO: 1160, SEQ ID NO: 1166, SEQ ID NO: 1172, SEQ ID NO: 1178, SEQ ID NO: 1184, SEQ ID NO: 1190, SEQ ID NO: 1196, SEQ ID NO: 1202, SEQ ID NO: 1208, SEQ ID NO: 1214, SEQ ID NO: 1220, SEQ ID NO: 1226, SEQ ID NO: 1232, SEQ ID NO: 1238, SEQ ID NO: 1244, SEQ ID NO: 1250, SEQ ID NO: 1256, SEQ ID NO: 1262, SEQ ID NO: 1268, SEQ ID NO: 1274, SEQ ID NO: 1280, SEQ ID NO: 1286, SEQ ID NO: 1292, SEQ ID NO: 1298, SEQ ID NO: 1304, SEQ ID NO: 1310, SEQ ID NO: 1316, SEQ ID NO: 1322, SEQ ID NO: 1328, SEQ ID NO: 1334, SEQ ID NO: 1340, SEQ ID NO: 1346, SEQ ID NO: 1352, SEQ ID NO: 1358, SEQ ID NO: 1364, SEQ ID NO: 1370, SEQ ID NO: 1376, SEQ ID NO: 1382, SEQ ID NO: 1388, SEQ ID NO: 1394, SEQ ID NO: 1400, SEQ ID NO: 1406, SEQ ID NO: 1412, SEQ ID NO: 1418, SEQ ID NO: 1424, SEQ ID NO: 1430, SEQ ID NO: 1436, SEQ ID NO: 1442, SEQ ID NO: 1448, SEQ ID NO: 1454, SEQ ID NO: 1460, SEQ ID NO: 1466, SEQ ID NO: 1472, SEQ ID NO: 1478, SEQ ID NO: 1484, SEQ ID NO: 1490, SEQ ID NO: 1496, SEQ ID NO: 1502, SEQ ID NO: 1508, SEQ ID NO: 1514, SEQ ID NO: 1520, SEQ ID NO: 1594, SEQ ID NO: 1526, SEQ ID NO: 1532, SEQ ID NO: 1538, SEQ ID NO: 1544, SEQ ID NO: 1550, SEQ ID NO: 1556, SEQ ID NO: 1562, SEQ ID NO: 1568, SEQ ID NO: 1574, SEQ ID NO: 1580, or SEQ ID NO: 1586 as shown in FIGS. 3A, 3B, 3C, 3D, 3E, 3F, 3G, 3H, 3I, 3J, 3K, or 3L, a heavy chain CDR3 comprising the amino acid sequence of any one of the HCDR3s in SEQ ID NO: 399, SEQ ID NO: 405, SEQ ID NO: 411, SEQ ID NO: 417, SEQ ID NO: 423, SEQ ID NO: 429, SEQ ID NO: 435, SEQ ID NO: 441, SEQ ID NO: 447, SEQ ID NO: 453, SEQ ID NO: 459, SEQ ID NO: 465, SEQ ID NO: 471, SEQ ID NO: 477, SEQ ID NO: 483, SEQ ID NO: 489, SEQ ID NO: 495, SEQ ID NO: 501, SEQ ID NO: 507, SEQ ID NO: 513, SEQ ID NO: 519, SEQ ID NO: 525, SEQ ID NO: 531, SEQ ID NO: 537, SEQ ID NO: 543, SEQ ID NO: 549, SEQ ID NO: 555, SEQ ID NO: 561, SEQ ID NO: 567, SEQ ID NO: 573, SEQ ID NO: 579, SEQ ID NO: 585, SEQ ID NO: 591, SEQ ID NO: 597, SEQ ID NO: 603, SEQ ID NO: 609, SEQ ID NO: 615, SEQ ID NO: 621, SEQ ID NO: 627, SEQ ID NO: 633, SEQ ID NO: 639, SEQ ID NO: 645, SEQ ID NO: 651, SEQ ID NO: 657, SEQ ID NO: 663, SEQ ID NO: 669, SEQ ID NO: 675, SEQ ID NO: 681, SEQ ID NO: 687, SEQ ID NO: 693, SEQ ID NO: 699, SEQ ID NO: 705, SEQ ID NO: 711, SEQ ID NO: 717, SEQ ID NO: 723, SEQ ID NO: 729, SEQ ID NO: 735, SEQ ID NO: 741, SEQ ID NO: 747, SEQ ID NO: 753, SEQ ID NO: 759, SEQ ID NO: 765, SEQ ID NO: 771, SEQ ID NO: 777, SEQ ID NO: 783, SEQ ID NO: 789, SEQ ID NO: 795, SEQ ID NO: 801, SEQ ID NO: 807, SEQ ID NO: 813, SEQ ID NO: 819, SEQ ID NO: 825, SEQ ID NO: 831, SEQ ID NO: 837, SEQ ID NO: 843, SEQ ID NO: 849, SEQ ID NO: 855, SEQ ID NO: 861, SEQ ID NO: 867, SEQ ID NO: 873, SEQ ID NO: 879, SEQ ID NO: 885, SEQ ID NO: 891, SEQ ID NO: 897, SEQ ID NO: 903, SEQ ID NO: 909, SEQ ID NO: 915, SEQ ID NO: 921, SEQ ID NO: 927, SEQ ID NO: 933, SEQ ID NO: 939, SEQ ID NO: 945, SEQ ID NO: 951, SEQ ID NO: 957, SEQ ID NO: 963, SEQ ID NO: 969, SEQ ID NO: 975, SEQ ID NO: 981, SEQ ID NO: 987, SEQ ID NO: 993, SEQ ID NO: 999, SEQ ID NO: 1005, SEQ ID NO: 1011, SEQ ID NO: 1017, SEQ ID NO: 1023, SEQ ID NO: 1029, SEQ ID NO: 1035, SEQ ID NO: 1041, SEQ ID NO: 1047, SEQ ID NO: 1053, SEQ ID NO: 1059, SEQ ID NO: 1065, SEQ ID NO: 1071, SEQ ID NO: 1077, SEQ ID NO: 1083, SEQ ID NO: 1089, SEQ ID NO: 1095, SEQ ID NO: 1101, SEQ ID NO: 1107, SEQ ID NO: 1113, SEQ ID NO: 1119, SEQ ID NO: 1125, SEQ ID NO: 1131, SEQ ID NO: 1137, SEQ ID NO: 1143, SEQ ID NO: 1149, SEQ ID NO: 1155, SEQ ID NO: 1161, SEQ ID NO: 1167, SEQ ID NO: 1173, SEQ ID NO: 1179, SEQ ID NO: 1185, SEQ ID NO: 1191, SEQ ID NO: 1197, SEQ ID NO: 1203, SEQ ID NO: 1209, SEQ ID NO: 1215, SEQ ID NO: 1221, SEQ ID NO: 1227, SEQ ID NO: 1233, SEQ ID NO: 1239, SEQ ID NO: 1245, SEQ ID NO: 1251, SEQ ID NO: 1257, SEQ ID NO: 1263, SEQ ID NO: 1269, SEQ ID NO: 1275, SEQ ID NO: 1281, SEQ ID NO: 1287, SEQ ID NO: 1293, SEQ ID NO: 1299, SEQ ID NO: 1305, SEQ ID NO: 1311, SEQ ID NO: 1317, SEQ ID NO: 1323, SEQ ID NO: 1329, SEQ ID NO: 1335, SEQ ID NO: 1341, SEQ ID NO: 1347, SEQ ID NO: 1353, SEQ ID NO: 1359, SEQ ID NO: 1365, SEQ ID NO: 1371, SEQ ID NO: 1377, SEQ ID NO: 1383, SEQ ID NO: 1389, SEQ ID NO: 1395, SEQ ID NO: 1401, SEQ ID NO: 1407, SEQ ID NO: 1413, SEQ ID NO: 1419, SEQ ID NO: 1425, SEQ ID NO: 1431, SEQ ID NO: 1437, SEQ ID NO: 1443, SEQ ID NO: 1449, SEQ ID NO: 1455, SEQ ID NO: 1461, SEQ ID NO: 1467, SEQ ID NO: 1473, SEQ ID NO: 1479, SEQ ID NO: 1485, SEQ ID NO: 1491, SEQ ID NO: 1497, SEQ ID NO: 1503, SEQ ID NO: 1509, SEQ ID NO: 1515, SEQ ID NO: 1521, SEQ ID NO: 1595, SEQ ID NO: 1527, SEQ ID NO: 1533, SEQ ID NO: 1539, SEQ ID NO: 1545, SEQ ID NO: 1551, SEQ ID NO: 1557, SEQ ID NO: 1563, SEQ ID NO: 1569, SEQ ID NO: 1575, SEQ ID NO: 1581, or SEQ ID NO: 1587 as shown in FIGS. 3A, 3B, 3C, 3D, 3E, 3F, 3G, 3H, 3I, 3J, 3K, or 3L, a light chain CDR1 comprising the amino acid sequence of any one of the LCDR1s in SEQ ID NO: 400, SEQ ID NO: 406, SEQ ID NO: 412, SEQ ID NO: 418, SEQ ID NO: 424, SEQ ID NO: 430, SEQ ID NO: 436, SEQ ID NO: 442, SEQ ID NO: 448, SEQ ID NO: 454, SEQ ID NO: 460, SEQ ID NO: 466, SEQ ID NO: 472, SEQ ID NO: 478, SEQ ID NO: 484, SEQ ID NO: 490, SEQ ID NO: 496, SEQ ID NO: 502, SEQ ID NO: 508, SEQ ID NO: 514, SEQ ID NO: 520, SEQ ID NO: 526, SEQ ID NO: 532, SEQ ID NO: 538, SEQ ID NO: 544, SEQ ID NO: 550, SEQ ID NO: 556, SEQ ID NO: 562, SEQ ID NO: 568, SEQ ID NO: 574, SEQ ID NO: 580, SEQ ID NO: 586, SEQ ID NO: 592, SEQ ID NO: 598, SEQ ID NO: 604, SEQ ID NO: 610, SEQ ID NO: 616, SEQ ID NO: 622, SEQ ID NO: 628, SEQ ID NO: 634, SEQ ID NO: 640, SEQ ID NO: 646, SEQ ID NO: 652, SEQ ID NO: 658, SEQ ID NO: 664, SEQ ID NO: 670, SEQ ID NO: 676, SEQ ID NO: 682, SEQ ID NO: 688, SEQ ID NO: 694, SEQ ID NO: 700, SEQ ID NO: 706, SEQ ID NO: 712, SEQ ID NO: 718, SEQ ID NO: 724, SEQ ID NO: 730, SEQ ID NO: 736, SEQ ID NO: 742, SEQ ID NO: 748, SEQ ID NO: 754, SEQ ID NO: 760, SEQ ID NO: 766, SEQ ID NO: 772, SEQ ID NO: 778, SEQ ID NO: 784, SEQ ID NO: 790, SEQ ID NO: 796, SEQ ID NO: 802, SEQ ID NO: 808, SEQ ID NO: 814, SEQ ID NO: 820, SEQ ID NO: 826, SEQ ID NO: 832, SEQ ID NO: 838, SEQ ID NO: 844, SEQ ID NO: 850, SEQ ID NO: 856, SEQ ID NO: 862, SEQ ID NO: 868, SEQ ID NO: 874, SEQ ID NO: 880, SEQ ID NO: 886, SEQ ID NO: 892, SEQ ID NO: 898, SEQ ID NO: 904, SEQ ID NO: 910, SEQ ID NO: 916, SEQ ID NO: 922, SEQ ID NO: 928, SEQ ID NO: 934, SEQ ID NO: 940, SEQ ID NO: 946, SEQ ID NO: 952, SEQ ID NO: 958, SEQ ID NO: 964, SEQ ID NO: 970, SEQ ID NO: 976, SEQ ID NO: 982, SEQ ID NO: 988, SEQ ID NO: 994, SEQ ID NO: 1000, SEQ ID NO: 1006, SEQ ID NO: 1012, SEQ ID NO: 1018, SEQ ID NO: 1024, SEQ ID NO: 1030, SEQ ID NO: 1036, SEQ ID NO: 1042, SEQ ID NO: 1048, SEQ ID NO: 1054, SEQ ID NO: 1060, SEQ ID NO: 1066, SEQ ID NO: 1072, SEQ ID NO: 1078, SEQ ID NO: 1084, SEQ ID NO: 1090, SEQ ID NO: 1096, SEQ ID NO: 1102, SEQ ID NO: 1108, SEQ ID NO: 1114, SEQ ID NO: 1120, SEQ ID NO: 1126, SEQ ID NO: 1132, SEQ ID NO: 1138, SEQ ID NO: 1144, SEQ ID NO: 1150, SEQ ID NO: 1156, SEQ ID NO: 1162, SEQ ID NO: 1168, SEQ ID NO: 1174, SEQ ID NO: 1180, SEQ ID NO: 1186, SEQ ID NO: 1192, SEQ ID NO: 1198, SEQ ID NO: 1204, SEQ ID NO: 1210, SEQ ID NO: 1216, SEQ ID NO: 1222, SEQ ID NO: 1228, SEQ ID NO: 1234, SEQ ID NO: 1240, SEQ ID NO: 1246, SEQ ID NO: 1252, SEQ ID NO: 1258, SEQ ID NO: 1264, SEQ ID NO: 1270, SEQ ID NO: 1276, SEQ ID NO: 1282, SEQ ID NO: 1288, SEQ ID NO: 1294, SEQ ID NO: 1300, SEQ ID NO: 1306, SEQ ID NO: 1312, SEQ ID NO: 1318, SEQ ID NO: 1324, SEQ ID NO: 1330, SEQ ID NO: 1336, SEQ ID NO: 1342, SEQ ID NO: 1348, SEQ ID NO: 1354, SEQ ID NO: 1360, SEQ ID NO: 1366, SEQ ID NO: 1372, SEQ ID NO: 1378, SEQ ID NO: 1384, SEQ ID NO: 1390, SEQ ID NO: 1396, SEQ ID NO: 1402, SEQ ID NO: 1408, SEQ ID NO: 1414, SEQ ID NO: 1420, SEQ ID NO: 1426, SEQ ID NO: 1432, SEQ ID NO: 1438, SEQ ID NO: 1444, SEQ ID NO: 1450. SEQ ID NO: 1456, SEQ ID NO: 1462, SEQ ID NO: 1468, SEQ ID NO: 1474, SEQ ID NO: 1480, SEQ ID NO: 1486, SEQ ID NO: 1492, SEQ ID NO: 1498, SEQ ID NO: 1504, SEQ ID NO: 1510, SEQ ID NO: 1516, SEQ ID NO: 1522, SEQ ID NO: 1596, SEQ ID NO: 1528, SEQ ID NO: 1534, SEQ ID NO: 1540, SEQ ID NO: 1546, SEQ ID NO: 1552, SEQ ID NO: 1558, SEQ ID NO: 1564, SEQ ID NO: 1570, SEQ ID NO: 1576, SEQ ID NO: 1582, or SEQ ID NO: 1588 as shown in FIGS. 3A, 3B, 3C, 3D, 3E, 3F, 3G, 3H, 3I, 3J, 3K, or 3L, a light chain CDR2 comprising the amino acid sequence of any one of the LCDR2s in SEQ ID NO: 401, SEQ ID NO: 407, SEQ ID NO: 413, SEQ ID NO: 419, SEQ ID NO: 425, SEQ ID NO: 431, SEQ ID NO: 437, SEQ ID NO: 443, SEQ ID NO: 449, SEQ ID NO: 455, SEQ ID NO: 461, SEQ ID NO: 467, SEQ ID NO: 473, SEQ ID NO: 479, SEQ ID NO: 485, SEQ ID NO: 491, SEQ ID NO: 497, SEQ ID NO: 503, SEQ ID NO: 509, SEQ ID NO: 515, SEQ ID NO: 521, SEQ ID NO: 527, SEQ ID NO: 533, SEQ ID NO: 539, SEQ ID NO: 545, SEQ ID NO: 551, SEQ ID NO: 557, SEQ ID NO: 563, SEQ ID NO: 569, SEQ ID NO: 575, SEQ ID NO: 581, SEQ ID NO: 587, SEQ ID NO: 593, SEQ ID NO: 599, SEQ ID NO: 605, SEQ ID NO: 611, SEQ ID NO: 617, SEQ ID NO: 623, SEQ ID NO: 629, SEQ ID NO: 635, SEQ ID NO: 641, SEQ ID NO: 647, SEQ ID NO: 653, SEQ ID NO: 659, SEQ ID NO: 665, SEQ ID NO: 671, SEQ ID NO: 677, SEQ ID NO: 683, SEQ ID NO: 689, SEQ ID NO: 695, SEQ ID NO: 701, SEQ ID NO: 707, SEQ ID NO: 713, SEQ ID NO: 719, SEQ ID NO: 725, SEQ ID NO: 731, SEQ ID NO: 737, SEQ ID NO: 743, SEQ ID NO: 749, SEQ ID NO: 755, SEQ ID NO: 761, SEQ ID NO: 767, SEQ ID NO: 773, SEQ ID NO: 779, SEQ ID NO: 785, SEQ ID NO: 791, SEQ ID NO: 797, SEQ ID NO: 803, SEQ ID NO: 809, SEQ ID NO: 815, SEQ ID NO: 821, SEQ ID NO: 827, SEQ ID NO: 833, SEQ ID NO: 839, SEQ ID NO: 845, SEQ ID NO: 851, SEQ ID NO: 857, SEQ ID NO: 863, SEQ ID NO: 869, SEQ ID NO: 875, SEQ ID NO: 881, SEQ ID NO: 887, SEQ ID NO: 893, SEQ ID NO: 899, SEQ ID NO: 905, SEQ ID NO: 911, SEQ ID NO: 917, SEQ ID NO: 923, SEQ ID NO: 929, SEQ ID NO: 935, SEQ ID NO: 941, SEQ ID NO: 947, SEQ ID NO: 953, SEQ ID NO: 959, SEQ ID NO: 965, SEQ ID NO: 971, SEQ ID NO: 977, SEQ ID NO: 983, SEQ ID NO: 989, SEQ ID NO: 995, SEQ ID NO: 1001, SEQ ID NO: 1007, SEQ ID NO: 1013, SEQ ID NO: 1019, SEQ ID NO: 1025, SEQ ID NO: 1031, SEQ ID NO: 1037, SEQ ID NO: 1043, SEQ ID NO: 1049, SEQ ID NO: 1055, SEQ ID NO: 1061, SEQ ID NO: 1067, SEQ ID NO: 1073, SEQ ID NO: 1079, SEQ ID NO: 1085, SEQ ID NO: 1091, SEQ ID NO: 1097, SEQ ID NO: 1103, SEQ ID NO: 1109, SEQ ID NO: 1115, SEQ ID NO: 1121, SEQ ID NO: 1127, SEQ ID NO: 1133, SEQ ID NO: 1139, SEQ ID NO: 1145, SEQ ID NO: 1151, SEQ ID NO: 1157, SEQ ID NO: 1163, SEQ ID NO: 1169, SEQ ID NO: 1175, SEQ ID NO: 1181, SEQ ID NO: 1187, SEQ ID NO: 1193, SEQ ID NO: 1199, SEQ ID NO: 1205, SEQ ID NO: 1211, SEQ ID NO: 1217, SEQ ID NO: 1223, SEQ ID NO: 1229, SEQ ID NO: 1235, SEQ ID NO: 1241, SEQ ID NO: 1247, SEQ ID NO: 1253, SEQ ID NO: 1259, SEQ ID NO: 1265, SEQ ID NO: 1271, SEQ ID NO: 1277, SEQ ID NO: 1283, SEQ ID NO: 1289, SEQ ID NO: 1295, SEQ ID NO: 1301, SEQ ID NO: 1307, SEQ ID NO: 1313, SEQ ID NO: 1319, SEQ ID NO: 1325, SEQ ID NO: 1331, SEQ ID NO: 1337, SEQ ID NO: 1343, SEQ ID NO: 1349, SEQ ID NO: 1355, SEQ ID NO: 1361, SEQ ID NO: 1367, SEQ ID NO: 1373, SEQ ID NO: 1379, SEQ ID NO: 1385, SEQ ID NO: 1391, SEQ ID NO: 1397, SEQ ID NO: 1403, SEQ ID NO: 1409, SEQ ID NO: 1415, SEQ ID NO: 1421, SEQ ID NO: 1427, SEQ ID NO: 1433, SEQ ID NO: 1439, SEQ ID NO: 1445, SEQ ID NO: 1451, SEQ ID NO: 1457, SEQ ID NO: 1463, SEQ ID NO: 1469, SEQ ID NO: 1475, SEQ ID NO: 1481, SEQ ID NO: 1487, SEQ ID NO: 1493, SEQ ID NO: 1499, SEQ ID NO: 1505, SEQ ID NO: 1511, SEQ ID NO: 1517, SEQ ID NO: 1523, SEQ ID NO: 1597, SEQ ID NO: 1529, SEQ ID NO: 1535, SEQ ID NO: 1541, SEQ ID NO: 1547, SEQ ID NO: 1553, SEQ ID NO: 1559, SEQ ID NO: 1565, SEQ ID NO: 1571, SEQ ID NO: 1577, SEQ ID NO: 1583, or SEQ ID NO: 1589 as shown in FIGS. 3A, 3B, 3C, 3D, 3E, 3F, 3G, 3H, 3I, 3J, 3K, or 3L, and a light chain CDR3 comprising the amino acid sequence of any one of the LCDR3s in SEQ ID NO: 402, SEQ ID NO: 408, SEQ ID NO: 414, SEQ ID NO: 420, SEQ ID NO: 426, SEQ ID NO: 432, SEQ ID NO: 438, SEQ ID NO: 444, SEQ ID NO: 450, SEQ ID NO: 456, SEQ ID NO: 462, SEQ ID NO: 468, SEQ ID NO: 474, SEQ ID NO: 480, SEQ ID NO: 486, SEQ ID NO: 492, SEQ ID NO: 498, SEQ ID NO: 504, SEQ ID NO: 510, SEQ ID NO: 516, SEQ ID NO: 522, SEQ ID NO: 528, SEQ ID NO: 534, SEQ ID NO: 540, SEQ ID NO: 546, SEQ ID NO: 552, SEQ ID NO: 558, SEQ ID NO: 564, SEQ ID NO: 570, SEQ ID NO: 576, SEQ ID NO: 582, SEQ ID NO: 588, SEQ ID NO: 594, SEQ ID NO: 600, SEQ ID NO: 606, SEQ ID NO: 612, SEQ ID NO: 618, SEQ ID NO: 624, SEQ ID NO: 630, SEQ ID NO: 636, SEQ ID NO: 642, SEQ ID NO: 648, SEQ ID NO: 654, SEQ ID NO: 660, SEQ ID NO: 666, SEQ ID NO: 672, SEQ ID NO: 678, SEQ ID NO: 684, SEQ ID NO: 690, SEQ ID NO: 696, SEQ ID NO: 702, SEQ ID NO: 708, SEQ ID NO: 714, SEQ ID NO: 720, SEQ ID NO: 726, SEQ ID NO: 732, SEQ ID NO: 738, SEQ ID NO: 744, SEQ ID NO: 750, SEQ ID NO: 756, SEQ ID NO: 762, SEQ ID NO: 768, SEQ ID NO: 774, SEQ ID NO: 780, SEQ ID NO: 786, SEQ ID NO: 792, SEQ ID NO: 798, SEQ ID NO: 804, SEQ ID NO: 810, SEQ ID NO: 816, SEQ ID NO: 822, SEQ ID NO: 828, SEQ ID NO: 834, SEQ ID NO: 840, SEQ ID NO: 846, SEQ ID NO: 852, SEQ ID NO: 858, SEQ ID NO: 864, SEQ ID NO: 870, SEQ ID NO: 876, SEQ ID NO: 882, SEQ ID NO: 888, SEQ ID NO: 894, SEQ ID NO: 900, SEQ ID NO: 906, SEQ ID NO: 912, SEQ ID NO: 918, SEQ ID NO: 924, SEQ ID NO: 930, SEQ ID NO: 936, SEQ ID NO: 942, SEQ ID NO: 948, SEQ ID NO: 954, SEQ ID NO: 960, SEQ ID NO: 966, SEQ ID NO: 972, SEQ ID NO: 978, SEQ ID NO: 984, SEQ ID NO: 990, SEQ ID NO: 996, SEQ ID NO: 1002, SEQ ID NO: 1008, SEQ ID NO: 1014, SEQ ID NO: 1020, SEQ ID NO: 1026, SEQ ID NO: 1032, SEQ ID NO: 1038, SEQ ID NO: 1044, SEQ ID NO: 1050, SEQ ID NO: 1056, SEQ ID NO: 1062, SEQ ID NO: 1068, SEQ ID NO: 1074, SEQ ID NO: 1080, SEQ ID NO: 1086, SEQ ID NO: 1092, SEQ ID NO: 1098, SEQ ID NO: 1104, SEQ ID NO: 1110, SEQ ID NO: 1116, SEQ ID NO: 1122, SEQ ID NO: 1128, SEQ ID NO: 1134, SEQ ID NO: 1140, SEQ ID NO: 1146, SEQ ID NO: 1152, SEQ ID NO: 1158, SEQ ID NO: 1164, SEQ ID NO: 1170, SEQ ID NO: 1176, SEQ ID NO: 1182, SEQ ID NO: 1188, SEQ ID NO: 1194, SEQ ID NO: 1200, SEQ ID NO: 1206, SEQ ID NO: 1212, SEQ ID NO: 1218, SEQ ID NO: 1224, SEQ ID NO: 1230, SEQ ID NO: 1236, SEQ ID NO: 1242, SEQ ID NO: 1248, SEQ ID NO: 1254, SEQ ID NO: 1260, SEQ ID NO: 1266, SEQ ID NO: 1272, SEQ ID NO: 1278, SEQ ID NO: 1284, SEQ ID NO: 1290, SEQ ID NO: 1296, SEQ ID NO: 1302, SEQ ID NO: 1308, SEQ ID NO: 1314, SEQ ID NO: 1320, SEQ ID NO: 1326, SEQ ID NO: 1332, SEQ ID NO: 1338, SEQ ID NO: 1344, SEQ ID NO: 1350, SEQ ID NO: 1356, SEQ ID NO: 1362, SEQ ID NO: 1368, SEQ ID NO: 1374, SEQ ID NO: 1380, SEQ ID NO: 1386, SEQ ID NO: 1392, SEQ ID NO: 1398, SEQ ID NO: 1404, SEQ ID NO: 1410, SEQ ID NO: 1416, SEQ ID NO: 1422, SEQ ID NO: 1428, SEQ ID NO: 1434, SEQ ID NO: 1440, SEQ ID NO: 1446, SEQ ID NO: 1452, SEQ ID NO: 1458, SEQ ID NO: 1464, SEQ ID NO: 1470, SEQ ID NO: 1476, SEQ ID NO: 1482, SEQ ID NO: 1488, SEQ ID NO: 1494, SEQ ID NO: 1500, SEQ ID NO: 1506, SEQ ID NO: 1512, SEQ ID NO: 1518, SEQ ID NO: 1524, SEQ ID NO: 1598, SEQ ID NO: 1530, SEQ ID NO: 1536, SEQ ID NO: 1542, SEQ ID NO: 1548, SEQ ID NO: 1554, SEQ ID NO: 1560, SEQ ID NO: 1566, SEQ ID NO: 1572, SEQ ID NO: 1578, SEQ ID NO: 1584, or SEQ ID NO: 1590 in FIG. 3A, 3B, 3C, 3D, 3E, 3F, 3G, 3H, 3I, 3J, 3K, or 3L, and the HCDR1, HCDR2, HCDR3, LCDR1, LCDR2, and LCDR3 are from a same clone.

In some embodiments, an isolated antibody comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 as shown in FIGS. 2A, 2B, 2C, 2D, 2E, 2F, 2G, 2H, 2I, 2J, 2K, 2L, 2M, 2N, 2O, 2P, 2Q or 2R.

In some embodiments, an isolated antibody comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 as shown in FIGS. 2A, 2B, 2C, 2D, 2E, 2F, 2G, 2H, 2I, 2J, 2K, 2L, 2M, 2N, 2O, 2P, 2Q or 2R, or a sequence at least 90% identical thereto.

In some embodiments, an isolated antibody comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 as shown in FIGS. 2A, 2B, 2C, 2D, 2E, 2F, 2G, 2H, 2I, 2J, 2K, 2l, 2M, 2N, 2O, 2P, 2Q or 2R, or a sequence with about 90, 91, 92, 93, 94, 95, 96, 97, 98, 99, 99.9% identity thereto, or a value within a range defined by any two of the aforementioned values.

In some embodiments, an isolated antibody that comprises a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 as shown in FIGS. 2A, 2B, 2C, 2D, 2E, 2F, 2G, 2H, 2I, 2J, 2K, 2L, 2M, 2N, 2O, 2P, 2Q or 2R.

In some embodiments, an isolated antibody that comprises a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 as shown in FIGS. 2A, 2B, 2C, 2D, 2E, 2F, 2G, 2H, 2I, 2J, 2K, 2L, 2M, 2N, 2O, 2P, 2Q or 2R, or a sequence at least 90% identical thereto.

In some embodiments, an isolated antibody that comprises a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 as shown in FIGS. 2A, 2B, 2C, 2D, 2E, 2F, 2G, 2H, 2I, 2J, 2K, 2L, 2M, 2N, 2O, 2P, 2Q or 2R, or a sequence with about 90, 91, 92, 93, 94, 95, 96, 97, 98, 99, 99.9% identity thereto, or a value within a range defined by any two of the aforementioned values.

In some embodiments, an isolated antibody comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 as shown in FIGS. 2A, 2B, 2C, 2D, 2E, 2F, 2G, 2H, 2I, 2J, 2K, 2L, 2M, 2N, 2O, 2P, 2Q or 2R, and a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 as shown in FIGS. 2A, 2B, 2C, 2D, 2E, 2F, 2G, 2H, 2I, 2J, 2K, 2L, 2M, 2N, 2O, 2P, 2Q or 2R.

In some embodiments, an isolated antibody comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 as shown in FIGS. 2A, 2B, 2C, 2D, 2E, 2F, 2G, 2H, 2I, 2J, 2K, 2L, 2M, 2N, 2O, 2P, 2Q or 2R, or a sequence at least 90% identical thereto, and a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 as shown in FIGS. 2A, 2B, 2C, 2D, 2E, 2F, 2G, 2H, 2I, 2J, 2K, 2L, 2M, 2N, 2O, 2P, 2Q or 2R or a sequence at least 90% identical thereto.

In some embodiments, an isolated antibody comprises a heavy chain comprising the heavy chain amino acid variable sequence in any one of SEQ ID NO. 1-SEQ ID NO: 97, SEQ ID NO: 195-SEQ ID NO: 209, or SEQ ID NO: 225-SEQ ID NO: 310 as shown in FIGS. 2A, 2B, 2C, 2D, 2E, 2F, 2G, 2H, 2I, 2J, 2K, 2L, 2M, 2N, 2O, 2P, 2Q or 2R, or a sequence with about 90, 91, 92, 93, 94, 95, 96, 97, 98, 99, 99.9% identity thereto, or a value within a range defined by any two of the aforementioned values, and a light chain comprising the light chain amino acid variable sequence in any one of SEQ ID NO: 98-SEQ ID NO: 194, SEQ ID NO: 210-SEQ ID NO: 224, or SEQ ID NO: 311-SEQ ID NO: 396 as shown in FIGS. 2A, 2B, 2C, 2D, 2E, 2F, 2G, 2H, 2I, 2J, 2K, 2L, 2M, 2N, 2O, 2P, 2Q or 2R, or a sequence with about 90, 91, 92, 93, 94, 95, 96, 97, 98, 99, 99.9% identity thereto, or a value within a range defined by any two of the aforementioned values.

In some embodiments, an isolated antigen binding molecule that binds to human TIGIT comprises a heavy chain variable region comprising the heavy chain of clone Ab117 (SEQ ID NO: 62) and a light chain variable region comprising the light chain of clone Ab117 (SEQ ID NO: 159).

In some embodiments, an isolated antigen binding molecule that binds to human TIGIT comprises a heavy chain variable region comprising the heavy chain of clone Ab53 (SEQ ID NO: 199) and a light chain variable region comprising the light chain of clone Ab53 (SEQ ID NO: 214).

In some embodiments, an isolated antigen binding molecule that binds to human TIGIT comprises a heavy chain variable region comprising the heavy chain of clone Ab40 (SEQ ID NO: 200) and a light chain variable region comprising the light chain of clone Ab40 (SEQ ID NO: 215).

In some embodiments, an isolated antigen binding molecule that binds to human TIGIT comprises a heavy chain variable region comprising the heavy chain of clone Ab48 (SEQ ID NO: 203) and a light chain variable region comprising the light chain of clone Ab48 (SEQ ID NO: 218).

In some embodiments, an isolated antigen binding molecule that binds to human TIGIT comprises a heavy chain variable region comprising the heavy chain of clone Ab1 (SEQ ID NO: 299) and a light chain variable region comprising the light chain of clone Ab1 (SEQ ID NO: 385).

In some embodiments, an isolated antigen binding molecule that binds to human TIGIT comprises a heavy chain variable region comprising the heavy chain of clone Ab143 (SEQ ID NO: 279) and a light chain variable region comprising the light chain of clone Ab143 (SEQ ID NO: 365).

In some embodiments, an isolated antigen binding molecule that binds to human TIGIT comprises a heavy chain variable region comprising the heavy chain of clone Ab117 (SEQ ID NO: 62) and a light chain variable region comprising the light chain of clone Ab117 (SEQ ID NO: 159), a heavy chain variable region comprising the heavy chain of clone Ab53 (SEQ ID NO: 199) and a light chain variable region comprising the light chain of clone Ab53 (SEQ ID NO: 214), a heavy chain variable region comprising the heavy chain of clone Ab40 (SEQ ID NO: 200) and a light chain variable region comprising the light chain of clone Ab40 (SEQ ID NO: 215), a heavy chain variable region comprising the heavy chain of clone Ab48 (SEQ ID NO: 203) and a light chain variable region comprising the light chain of clone Ab48 (SEQ ID NO: 218), a heavy chain variable region comprising the heavy chain of clone Ab1 (SEQ ID NO: 299) and a light chain variable region comprising the light chain of clone Ab1 (SEQ ID NO: 385), or a heavy chain variable region comprising the heavy chain of clone Ab143 (SEQ ID NO: 279) and a light chain variable region comprising the light chain of clone Ab143 (SEQ ID NO: 365).

All of the references cited herein, including patents, patent applications, papers, text books, and the like, and the references cited therein, to the extent that they are not already, are hereby incorporated herein by reference in their entirety. To the extent that any of the definitions or terms provided in the references incorporated by reference are inconsistent with the terms and discussion provided herein, the present terms and definitions control.

SEQUENCE LISTING (1606 sequences)

SEQ ID NO: 1 - protein, 118 aa, Artificial
  Synthetic
EVQLLESGGGLVQPGGSLRLSCAASGFTFSSYAMSWVRQAPGKGLEWVSSIKSSAGSSYYADSVKGRFTISRDNSKNTLYLQMNSLRAEDTAVYYCAREPYDVWIDYWGQGTLVTVSS

SEQ ID NO: 2 - protein, 118 aa, Artificial
  Synthetic
EVQLLESGGGLVQPGGSLRLSCAASGFTFSSYSMSWVRQAPGKGLEWVAAIKGSTSSSYYADSVKGRFTISRDNSKNTLYLQMNSLRAEDTAVYYCAREPYDVWLDYWGQGTLVTVSS

SEQ ID NO: 3 - protein, 118 aa, Artificial
  Synthetic
EVQLLESGGGLVQPGGSLRLSCAASGFTFSSYSMSWVRQAPGKGLEWVAAIKSNAGTSSYADSVKGRFTISRDNSKNTLYLQMNSLRAEDTAVYYCAREPYDVWLDYWGQGTLVTVSS

SEQ ID NO: 4 - protein, 118 aa, Artificial
  Synthetic
EVQLLESGGGLVQPGGSLRLSCAASGFTFSSYAMSWVRQAPGKGLEWVSSISSNTGSISYADSVKGRFTISRDNSKNTLYLQMNSLRAEDTAVYYCAREPYDVWLDYWGQGTLVTVSS

SEQ ID NO: 5 - protein, 118 aa, Artificial
  Synthetic
EVQLLESGGGLVQPGGSLRLSCAASGFTFSSYSMSWVRQAPGKGLEWVADISSSASTIGYADSVKGRFTISRDNSKNTLYLQMNSLRAEDTAVYYCAREPYDVWMDYWGQGTLVTVSS

SEQ ID NO: 6 - protein, 118 aa, Artificial
  Synthetic
EVQLLESGGGLVQPGGSLRLSCAASGFTFSSYSMSWVRQAPGKGLEWVSAISGSGGSTYYADSVKGRFTISRDNSKNTLYLQMNSLRAEDTAVYYCAREPYDVWMDYWGQGTLVTVSS

SEQ ID NO: 7 - protein, 118 aa, Artificial
  Synthetic
EVQLLESGGGLVQPGGSLRLSCAASGFTFSSYSMSWVRQAPGKGLEWVSSISSNTGTSYYADSVKGRFTISRDNSKNTLYLQMNSLRAEDTAVYYCAREPYDVWMDYWGQGTLVTVSS

SEQ ID NO: 8 - protein, 118 aa, Artificial; identical to SEQ ID NO: 7
  Synthetic

SEQ ID NO: 9 - protein, 118 aa, Artificial
  Synthetic
EVQLLESGGGLVQPGGSLRLSCAASGFTFSSYSMSWVRQAPGKGLEWVAAISGSAGTSGYADSVKGRFTISRDNSKNTLYLQMNSLRAEDTAVYYCAREPYDYWLDYWGQGTLVTVSS

SEQ ID NO: 10 - protein, 118 aa, Artificial
  Synthetic
EVQLLESGGGLVQPGGSLRLSCAASGFTFSSYSMSWVRQAPGKGLEWVADIKSSGSTKSYADSVKGRFTISRDNSKNTLYLQMNSLRAEDTAVYYCAREPYDYWMDYWGQGTLVTVSS

SEQ ID NO: 11 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYDYWMDYWGQGTLVTVSS

SEQ ID NO: 12 - protein, 118 aa, Artificial; identical to SEQ ID NO: 11
  Synthetic

SEQ ID NO: 13 - protein, 118 aa, Artificial
  Synthetic
EVQLLESGGGLVQPGGSLRLSCAASGFTFSSYAMSWVRQAPGKGLEWVASINSNGGYKSYADSVKGRFTISRDNSKNTLYLQMNSLRAEDTAVYYCAREPYGTWLDYWGQGTLVTVSS

SEQ ID NO: 14 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYGVWIDYWGQGTLVTVSS

SEQ ID NO: 15 - protein, 118 aa, Artificial
  Synthetic
EVQLLESGGGLVQPGGSLRLSCAASGFTFSSYSMNWVRQAPGKGLEWVASIKGSASTIYYADSVKGRFTISRDNSKNTLYLQMNSLRAEDTAVYYCAREPYGVWLDYWGQGTLVTVSS

SEQ ID NO: 16 - protein, 118 aa, Artificial
  Synthetic
EVQLLESGGGLVQPGGSLRLSCAASGFTFSSYAMSWVRQAPGKGLEWVASIKSNTGSSSYADSVKGRFTISRDNSKNTLYLQMNSLRAEDTAVYYCAREPYGVWLDYWGQGTLVTVSS

SEQ ID NO: 17 - protein, 118 aa, Artificial
  Synthetic
EVQLLESGGGLVQPGGSLRLSCAASGFTFSSYSMSWVRQAPGKGLEWVASISSSAGTSSYADSVKGRFTISRDNSKNTLYLQMNSLRAEDTAVYYCAREPYGVWLDYWGQGTLVTVSS

SEQ ID NO: 18 - protein, 118 aa, Artificial
  Synthetic
EVQLLESGGGLVQPGGSLRLSCAASGFTFSSYAMSWVRQAPGKGLEWVAYINSNTGTIYYADSVKGRFTISRDNSKNTLYLQMNSLRAEDTAVYYCAREPYGVWLDYWGQGTLVTVSS

SEQ ID NO: 19 - protein, 118 aa, Artificial
  Synthetic
EVQLLESGGGLVQPGGSLRLSCAASGFTFSSYAMSWVRQAPGKGLEWVAYISGNTGYIGYADSVKGRFTISRDNSKNTLYLQMNSLRAEDTAVYYCAREPYGVWLDYWGQGTLVTVSS

SEQ ID NO: 20 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYGVWLDYWGQGTLVTVSS

SEQ ID NO: 21 - protein, 118 aa, Artificial; identical to SEQ ID NO: 20
  Synthetic

SEQ ID NO: 22 - protein, 118 aa, Artificial
  Synthetic
EVQLLESGGGLVQPGGSLRLSCAASGFTFSSYSMSWVRQAPGKGLEWVSAISSNAGSTSYADSVKGRFTISRDNSKNTLYLQMNSLRAEDTAVYYCAREPYGVWLDYWGQGTLVTVSS

SEQ ID NO: 23 - protein, 118 aa, Artificial
  Synthetic
EVQLLESGGGLVQPGGSLRLSCAASGFTFSSYSMSWVRQAPGKGLEWVSSINSNAGTTYYADSVKGRFTISRDNSKNTLYLQMNSLRAEDTAVYYCAREPYGVWLDYWGQGTLVTVSS

SEQ ID NO: 24 - protein, 118 aa, Artificial; identical to SEQ ID NO: 23
  Synthetic

SEQ ID NO: 25 - protein, 118 aa, Artificial
  Synthetic
EVQLLESGGGLVQPGGSLRLSCAASGFTFDSYSMNWVRQAPGKGLEWVAAIKSDASTIGYADSVKGRFTISRDNSKNTLYLQMNSLRAEDTAVYYCAREPYGVWMDYWGQGTLVTVSS

SEQ ID NO: 26 - protein, 118 aa, Artificial
  Synthetic
EVQLLESGGGLVQPGGSLRLSCAASGFTFSSYSMNWVRQAPGKGLEWVAAISGSTGTISYADSVKGRFTISRDNSKNTLYLQMNSLRAEDTAVYYCAREPYGVWMDYWGQGTLVTVSS

SEQ ID NO: 27 - protein, 118 aa, Artificial
  Synthetic
EVQLLESGGGLVQPGGSLRLSCAASGFTFSSYGMNWVRQAPGKGLEWVANINSNSGSIYYADSVKGRFTISRDNSKNTLYLQMNSLRAEDTAVYYCAREPYGVWMDYWGQGTLVTVSS

SEQ ID NO: 28 - protein, 118 aa, Artificial
  Synthetic
EVQLLESGGGLVQPGGSLRLSCAASGFTFDSYAMNWVRQAPGKGLEWVASINSNTGSIYYADSVKGRFTISRDNSKNTLYLQMNSLRAEDTAVYYCAREPYGVWMDYWGQGTLVTVSS

SEQ ID NO: 29 - protein, 118 aa, Artificial; identical to SEQ ID NO: 28
  Synthetic

SEQ ID NO: 30 - protein, 118 aa, Artificial
  Synthetic
EVQLLESGGGLVQPGGSLRLSCAASGFTFSSYSMSWVRQAPGKGLEWVSAINGNAGSIGYADSVKGRFTISRDNSKNTLYLQMNSLRAEDTAVYYCAREPYGVWMDYWGQGTLVTVSS

SEQ ID NO: 31 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYGVWMDYWGQGTLVTVSS

SEQ ID NO: 32 - protein, 118 aa, Artificial
  Synthetic
EVQLLESGGGLVQPGGSLRLSCAASGFTFSSYAMSWVRQAPGKGLEWVSYINSNTGSIGYADSVKGRFTISRDNSKNTLYLQMNSLRAEDTAVYYCAREPYGVWMDYWGQGTLVTVSS

SEQ ID NO: 33 - protein, 118 aa, Artificial; identical to SEQ ID NO: 32
  Synthetic

SEQ ID NO: 34 - protein, 118 aa, Artificial
  Synthetic
EVQLLESGGGLVQPGGSLRLSCAASGFTFSSYSMSWVRQAPGKGLEWVAAIKGSAGTSGYADSVKGRFTISRDNSKNTLYLQMNSLRAEDTAVYYCAREPYGYWLDYWGQGTLVTVSS

SEQ ID NO: 35 - protein, 118 aa, Artificial
  Synthetic
EVQLLESGGGLVQPGGSLRLSCAASGFTFSSYAMSWVRQAPGKGLEWVASISGNTGTSSYADSVKGRFTISRDNSKNTLYLQMNSLRAEDTAVYYCAREPYGYWLDYWGQGTLVTVSS

SEQ ID NO: 36 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYGYWLDYWGQGTLVTVSS

SEQ ID NO: 37 - protein, 118 aa, Artificial
  Synthetic
EVQLLESGGGLVQPGGSLRLSCAASGFTFSSYAMSWVRQAPGKGLEWVSSIWSNGGSIYYADSVKGRFTISRDNSKNTLYLQMNSLRAEDTAVYYCAREPYGYWLDYWGQGTLVTVSS

SEQ ID NO: 38 - protein, 118 aa, Artificial
  Synthetic
EVQLLESGGGLVQPGGSLRLSCAASGFTFSSYSMNWVRQAPGKGLEWVASIKSSTGTTGYADSVKGRFTISRDNSKNTLYLQMNSLRAEDTAVYYCAREPYGYWMDYWGQGTLVTVSS

SEQ ID NO: 39 - protein, 118 aa, Artificial
  Synthetic
EVQLLESGGGLVQPGGSLRLSCAASGFTFSSYAMSWVRQAPGKGLEWVASIKSSTGYISYADSVKGRFTISRDNSKNTLYLQMNSLRAEDTAVYYCAREPYGYWMDYWGQGTLVTVSS

SEQ ID NO: 40 - protein, 118 aa, Artificial
  Synthetic
EVQLLESGGGLVQPGGSLRLSCAASGFTFSSYSMSWVRQAPGKGLEWVASISGSASYSYYADSVKGRFTISRDNSKNTLYLQMNSLRAEDTAVYYCAREPYGYWMDYWGQGTLVTVSS

SEQ ID NO: 41 - protein, 118 aa, Artificial
  Synthetic
EVQLLESGGGLVQPGGSLRLSCAASGFTFSSYSMSWVRQAPGKGLEWVSDIKSSAGSTYYADSVKGRFTISRDNSKNTLYLQMNSLRAEDTAVYYCAREPYGYWMDYWGQGTLVTVSS

SEQ ID NO: 42 - protein, 118 aa, Artificial
  Synthetic
EVQLLESGGGLVQPGGSLRLSCAASGFTFSSYAMSWVRQAPGKGLEWVASIKSSGSYKSYADSVKGRFTISRDNSKNTLYLQMNSLRAEDTAVYYCAREPYSTWLDYWGQGTLVTVSS

SEQ ID NO: 43 - protein, 118 aa, Artificial
  Synthetic
EVQLLESGGGLVQPGGSLRLSCAASGFTFSSYAMSWVRQAPGKGLEWVSAIKSDTSTIYYADSVKGRFTISRDNSKNTLYLQMNSLRAEDTAVYYCAREPYSTWLDYWGQGTLVTVSS

SEQ ID NO: 44 - protein, 118 aa, Artificial
  Synthetic
EVQLLESGGGLVQPGGSLRLSCAASGFTFSSYAMSWVRQAPGKGLEWVAAIKGNAGSTSYADSVKGRFTISRDNSKNTLYLQMNSLRAEDTAVYYCAREPYSTWMDYWGQGTLVTVSS

SEQ ID NO: 45 - protein, 118 aa, Artificial
  Synthetic
EVQLLESGGGLVQPGGSLRLSCAASGFTFSSYAMNWVRQAPGKGLEWVASIKSSTGTISYADSVKGRFTISRDNSKNTLYLQMNSLRAEDTAVYYCAREPYSVWIDYWGQGTLVTVSS

SEQ ID NO: 46 - protein, 118 aa, Artificial
  Synthetic
EVQLLESGGGLVQPGGSLRLSCAASGFTFSSYAMSWVRQAPGKGLEWVASIKSSTGTTGYADSVKGRFTISRDNSKNTLYLQMNSLRAEDTAVYYCAREPYSVWIDYWGQGTLVTVSS

SEQ ID NO: 47 - protein, 118 aa, Artificial
  Synthetic
EVQLLESGGGLVQPGGSLRLSCAASGFTFSSYAMNWVRQAPGKGLEWVAYIKSDTGSIGYADSVKGRFTISRDNSKNTLYLQMNSLRAEDTAVYYCAREPYSVWIDYWGQGTLVTVSS

SEQ ID NO: 48 - protein, 118 aa, Artificial
  Synthetic
EVQLLESGGGLVQPGGSLRLSCAASGFTFSSYAMSWVRQAPGKGLEWVAAIKSSTGTIYYADSVKGRFTISRDNSKNTLYLQMNSLRAEDTAVYYCAREPYSVWLDYWGQGTLVTVSS

SEQ ID NO: 49 - protein, 118 aa, Artificial
  Synthetic
EVQLLESGGGLVQPGGSLRLSCAASGFTFSSYSMNWVRQAPGKGLEWVAAISGDTGTSGYADSVKGRFTISRDNSKNTLYLQMNSLRAEDTAVYYCAREPYSVWLDYWGQGTLVTVSS

SEQ ID NO: 50 - protein, 118 aa, Artificial
  Synthetic
EVQLLESGGGLVQPGGSLRLSCAASGFTFSSYSMSWVRQAPGKGLEWVANIKSNSGYTYYADSVKGRFTISRDNSKNTLYLQMNSLRAEDTAVYYCAREPYSVWLDYWGQGTLVTVSS

SEQ ID NO: 51 - protein, 118 aa, Artificial
  Synthetic
EVQLLESGGGLVQPGGSLRLSCAASGFTFSDYSMSWVRQAPGKGLEWVARISSSSSYKSYADSVKGRFTISRDNSKNTLYLQMNSLRAEDTAVYYCAREPYSVWLDYWGQGTLVTVSS

SEQ ID NO: 52 - protein, 118 aa, Artificial
  Synthetic
EVQLLESGGGLVQPGGSLRLSCAASGFTFSSYSMSWVRQAPGKGLEWVASIKSDASTTGYADSVKGRFTISRDNSKNTLYLQMNSLRAEDTAVYYCAREPYSVWLDYWGQGTLVTVSS

SEQ ID NO: 53 - protein, 118 aa, Artificial
  Synthetic
EVQLLESGGGLVQPGGSLRLSCAASGFTFSSYAMSWVRQAPGKGLEWVASIKSNTGSTYYADSVKGRFTISRDNSKNTLYLQMNSLRAEDTAVYYCAREPYSVWLDYWGQGTLVTVSS

SEQ ID NO: 54 - protein, 118 aa, Artificial
  Synthetic
EVQLLESGGGLVQPGGSLRLSCAASGFTFSSYAMSWVRQAPGKGLEWVAYIKSNTGSISYADSVKGRFTISRDNSKNTLYLQMNSLRAEDTAVYYCAREPYSVWLDYWGQGTLVTVSS

SEQ ID NO: 55 - protein, 118 aa, Artificial
  Synthetic
EVQLLESGGGLVQPGGSLRLSCAASGFTFSSYSMSWVRQAPGKGLEWVAYISSNTGSTYYADSVKGRFTISRDNSKNTLYLQMNSLRAEDTAVYYCAREPYSVWLDYWGQGTLVTVSS

SEQ ID NO: 56 - protein, 118 aa, Artificial
  Synthetic
EVQLLESGGGLVQPGGSLRLSCAASGFTFSSYAMSWVRQAPGKGLEWVSAINSNAGYTYYADSVKGRFTISRDNSKNTLYLQMNSLRAEDTAVYYCAREPYSVWLDYWGQGTLVTVSS

SEQ ID NO: 57 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSVWLDYWGQGTLVTVSS

SEQ ID NO: 58 - protein, 118 aa, Artificial; identical to SEQ ID NO: 57
  Synthetic

SEQ ID NO: 59 - protein, 118 aa, Artificial
  Synthetic
EVQLLESGGGLVQPGGSLRLSCAASGFTFSSYAMSWVRQAPGKGLEWVSSIKSNTGSTYYADSVKGRFTISRDNSKNTLYLQMNSLRAEDTAVYYCAREPYSVWLDYWGQGTLVTVSS

SEQ ID NO: 60 - protein, 118 aa, Artificial
  Synthetic
EVQLLESGGGLVQPGGSLRLSCAASGFTFSSYSMSWVRQAPGKGLEWVSSIKSSTGSTYYADSVKGRFTISRDNSKNTLYLQMNSLRAEDTAVYYCAREPYSVWLDYWGQGTLVTVSS

SEQ ID NO: 61 - protein, 118 aa, Artificial
  Synthetic
EVQLLESGGGLVQPGGSLRLSCAASGFTFSSYAMSWVRQAPGKGLEWVAAIKSSASTIYYADSVKGRFTISRDNSKNTLYLQMNSLRAEDTAVYYCAREPYSVWMDYWGQGTLVTVSS

SEQ ID NO: 62 - protein, 118 aa, Artificial; identical to SEQ ID NO: 61
  Synthetic

SEQ ID NO: 63 - protein, 118 aa, Artificial; identical to SEQ ID NO: 61
  Synthetic

SEQ ID NO: 64 - protein, 118 aa, Artificial
  Synthetic
EVQLLESGGGLVQPGGSLRLSCAASGFTFSSYAMNWVRQAPGKGLEWVAAISSSAGTSSYADSVKGRFTISRDNSKNTLYLQMNSLRAEDTAVYYCAREPYSVWMDYWGQGTLVTVSS

SEQ ID NO: 65 - protein, 118 aa, Artificial
  Synthetic
EVQLLESGGGLVQPGGSLRLSCAASGFTFSSYAMSWVRQAPGKGLEWVADISGSASSSYYADSVKGRFTISRDNSKNTLYLQMNSLRAEDTAVYYCAREPYSVWMDYWGQGTLVTVSS

SEQ ID NO: 66 - protein, 118 aa, Artificial
  Synthetic
EVQLLESGGGLVQPGGSLRLSCAASGFTFSSYAMSWVRQAPGKGLEWVASIKSSTGTSYYADSVKGRFTISRDNSKNTLYLQMNSLRAEDTAVYYCAREPYSVWMDYWGQGTLVTVSS

SEQ ID NO: 67 - protein, 118 aa, Artificial
  Synthetic
EVQLLESGGGLVQPGGSLRLSCAASGFTFSSYSMSWVRQAPGKGLEWVASIKSSTGYTSYADSVKGRFTISRDNSKNTLYLQMNSLRAEDTAVYYCAREPYSVWMDYWGQGTLVTVSS

SEQ ID NO: 68 - protein, 118 aa, Artificial
  Synthetic
EVQLLESGGGLVQPGGSLRLSCAASGFTFSSYAMSWVRQAPGKGLEWVASIKSSTSSTYYADSVKGRFTISRDNSKNTLYLQMNSLRAEDTAVYYCAREPYSVWMDYWGQGTLVTVSS

SEQ ID NO: 69 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSVWMDYWGQGTLVTVSS

SEQ ID NO: 70 - protein, 118 aa, Artificial; identical to SEQ ID NO: 69
  Synthetic

SEQ ID NO: 71 - protein, 118 aa, Artificial; identical to SEQ ID NO: 69
  Synthetic

SEQ ID NO: 72 - protein, 118 aa, Artificial; identical to SEQ ID NO: 69
  Synthetic

SEQ ID NO: 73 - protein, 118 aa, Artificial
  Synthetic
EVQLLESGGGLVQPGGSLRLSCAASGFTFSSYSMNWVRQAPGKGLEWVSSIKGSAGTTSYADSVKGRFTISRDNSKNTLYLQMNSLRAEDTAVYYCAREPYSVWMDYWGQGTLVTVSS

SEQ ID NO: 74 - protein, 118 aa, Artificial
  Synthetic
EVQLLESGGGLVQPGGSLRLSCAASGFTFSSYAMSWVRQAPGKGLEWVSSIKSNSGSKSYADSVKGRFTISRDNSKNTLYLQMNSLRAEDTAVYYCAREPYSVWMDYWGQGTLVTVSS

SEQ ID NO: 75 - protein, 118 aa, Artificial
  Synthetic
EVQLLESGGGLVQPGGSLRLSCAASGFTFSSYSMSWVRQAPGKGLEWVAAIKGSAGSSSYADSVKGRFTISRDNSKNTLYLQMNSLRAEDTAVYYCAREPYSYWLDYWGQGTLVTVSS

SEQ ID NO: 76 - protein, 118 aa, Artificial
  Synthetic
EVQLLESGGGLVQPGGSLRLSCAASGFTFSSYAMSWVRQAPGKGLEWVAAIKSNAGSSYYADSVKGRFTISRDNSKNTLYLQMNSLRAEDTAVYYCAREPYSYWLDYWGQGTLVTVSS

SEQ ID NO: 77 - protein, 118 aa, Artificial
  Synthetic
EVQLLESGGGLVQPGGSLRLSCAASGFTFSSYAMSWVRQAPGKGLEWVARINSDSSNTYYADSVKGRFTISRDNSKNTLYLQMNSLRAEDTAVYYCAREPYSYWLDYWGQGTLVTVSS

SEQ ID NO: 78 - protein, 118 aa, Artificial
  Synthetic
EVQLLESGGGLVQPGGSLRLSCAASGFTFSSYAMSWVRQAPGKGLEWVASIKSSSSSISYADSVKGRFTISRDNSKNTLYLQMNSLRAEDTAVYYCAREPYSYWLDYWGQGTLVTVSS

SEQ ID NO: 79 - protein, 118 aa, Artificial
  Synthetic
EVQLLESGGGLVQPGGSLRLSCAASGFTFSSYAMSWVRQAPGKGLEWVASIKSSTGYIGYADSVKGRFTISRDNSKNTLYLQMNSLRAEDTAVYYCAREPYSYWLDYWGQGTLVTVSS

SEQ ID NO: 80 - protein, 118 aa, Artificial
  Synthetic
EVQLLESGGGLVQPGGSLRLSCAASGFTFSSYAMSWVRQAPGKGLEWVASINGNAGTISYADSVKGRFTISRDNSKNTLYLQMNSLRAEDTAVYYCAREPYSYWLDYWGQGTLVTVSS

SEQ ID NO: 81 - protein, 118 aa, Artificial
  Synthetic
EVQLLESGGGLVQPGGSLRLSCAASGFTFSSYAMSWVRQAPGKGLEWVASINSNTGSIGYADSVKGRFTISRDNSKNTLYLQMNSLRAEDTAVYYCAREPYSYWLDYWGQGTLVTVSS

SEQ ID NO: 82 - protein, 118 aa, Artificial
  Synthetic
EVQLLESGGGLVQPGGSLRLSCAASGFTFSSYAMSWVRQAPGKGLEWVASISSSTGYTSYADSVKGRFTISRDNSKNTLYLQMNSLRAEDTAVYYCAREPYSYWLDYWGQGTLVTVSS

SEQ ID NO: 83 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSYWLDYWGQGTLVTVSS

SEQ ID NO: 84 - protein, 118 aa, Artificial
  Synthetic
EVQLLESGGGLVQPGGSLRLSCAASGFTFSSYAMSWVRQAPGKGLEWVSSIKSDTSSTYYADSVKGRFTISRDNSKNTLYLQMNSLRAEDTAVYYCAREPYSYWLDYWGQGTLVTVSS

SEQ ID NO: 85 - protein, 118 aa, Artificial
  Synthetic
EVQLLESGGGLVQPGGSLRLSCAASGFTFSSYAMSWVRQAPGKGLEWVSSIKSNTGSTSYADSVKGRFTISRDNSKNTLYLQMNSLRAEDTAVYYCAREPYSYWLDYWGQGTLVTVSS

SEQ ID NO: 86 - protein, 118 aa, Artificial
  Synthetic
EVQLLESGGGLVQPGGSLRLSCAASGFTFSSYSMNWVRQAPGKGLEWVAAISGNTGYTYYADSVKGRFTISRDNSKNTLYLQMNSLRAEDTAVYYCAREPYSYWMDYWGQGTLVTVSS

SEQ ID NO: 87 - protein, 118 aa, Artificial
  Synthetic
EVQLLESGGGLVQPGGSLRLSCAASGFTFSSYAMSWVRQAPGKGLEWVANIKSNSGYTSYADSVKGRFTISRDNSKNTLYLQMNSLRAEDTAVYYCAREPYSYWMDYWGQGTLVTVSS

SEQ ID NO: 88 - protein, 118 aa, Artificial
  Synthetic
EVQLLESGGGLVQPGGSLRLSCAASGFTFDSYAMNWVRQAPGKGLEWVASIKSNAGYSSYADSVKGRFTISRDNSKNTLYLQMNSLRAEDTAVYYCAREPYSYWMDYWGQGTLVTVSS

SEQ ID NO: 89 - protein, 118 aa, Artificial
  Synthetic
EVQLLESGGGLVQPGGSLRLSCAASGFTFSSYAMNWVRQAPGKGLEWVASIKSNTGTTGYADSVKGRFTISRDNSKNTLYLQMNSLRAEDTAVYYCAREPYSYWMDYWGQGTLVTVSS

SEQ ID NO: 90 - protein, 118 aa, Artificial
  Synthetic
EVQLLESGGGLVQPGGSLRLSCAASGFTFSSYSMSWVRQAPGKGLEWVASIKSSASYSSYADSVKGRFTISRDNSKNTLYLQMNSLRAEDTAVYYCAREPYSYWMDYWGQGTLVTVSS

SEQ ID NO: 91 - protein, 118 aa, Artificial
  Synthetic
EVQLLESGGGLVQPGGSLRLSCAASGFTFSSYAMSWVRQAPGKGLEWVASIKSSGGNTYYADSVKGRFTISRDNSKNTLYLQMNSLRAEDTAVYYCAREPYSYWMDYWGQGTLVTVSS

SEQ ID NO: 92 - protein, 118 aa, Artificial
  Synthetic
EVQLLESGGGLVQPGGSLRLSCAASGFTFSSYAMSWVRQAPGKGLEWVASIKSSTSSTYYADSVKGRFTISRDNSKNTLYLQMNSLRAEDTAVYYCAREPYSYWMDYWGQGTLVTVSS

SEQ ID NO: 93 - protein, 118 aa, Artificial
  Synthetic
EVQLLESGGGLVQPGGSLRLSCAASGFTFSSYAMSWVRQAPGKGLEWVASISSSGGNTYYADSVKGRFTISRDNSKNTLYLQMNSLRAEDTAVYYCAREPYSYWMDYWGQGTLVTVSS

SEQ ID NO: 94 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREPYSYWMDYWGQGTLVTVSS

SEQ ID NO: 95 - protein, 118 aa, Artificial
  Synthetic
EVQLLESGGGLVQPGGSLRLSCAASGFTFSSYAMNWVRQAPGKGLEWVSSISGNAGSIYYADSVKGRFTISRDNSKNTLYLQMNSLRAEDTAVYYCAREPYSYWMDYWGQGTLVTVSS

SEQ ID NO: 96 - protein, 118 aa, Artificial; identical to SEQ ID NO: 95
  Synthetic

SEQ ID NO: 97 - protein, 118 aa, Artificial; identical to SEQ ID NO: 95
  Synthetic

SEQ ID NO: 98 - protein, 107 aa, Artificial
  Synthetic
DIQMTQSPSSLSASVGDRVTITCRASQSISYYLNWYQQKPGKAPKLLIYAASSLQSGVPSRFSGSGSGTDFTLTISSLQPEDFATYYCQQSYSTPLTFGGGTKVEIK

SEQ ID NO: 99 - protein, 107 aa, Artificial [sequence omitted]

SEQ ID NO: 100 - protein, 107 aa, Artificial [sequence omitted]

SEQ ID NO: 101 - protein, 107 aa, Artificial [sequence omitted]

SEQ ID NO: 102 - protein, 107 aa, Artificial; identical to SEQ ID NO: 98
  Synthetic

SEQ ID NO: 103 - protein, 107 aa, Artificial [sequence omitted]

SEQ ID NO: 104 - protein, 107 aa, Artificial; identical to SEQ ID NO: 98
  Synthetic

SEQ ID NO: 105 - protein, 107 aa, Artificial; identical to SEQ ID NO: 98
  Synthetic

SEQ ID NO: 106 - protein, 107 aa, Artificial [sequence omitted]

SEQ ID NO: 107 - protein, 107 aa, Artificial [sequence omitted]

SEQ ID NO: 108 - protein, 107 aa, Artificial [sequence omitted]

SEQ ID NO: 109 - protein, 107 aa, Artificial [sequence omitted]

SEQ ID NO: 110 - protein, 107 aa, Artificial [sequence omitted]

SEQ ID NO: 111 - protein, 107 aa, Artificial; identical to SEQ ID NO: 98
  Synthetic

SEQ ID NO: 112 - protein, 107 aa, Artificial
  Synthetic
DIQMTQSPSSLSASVGDRVTITCRASQSISYYVNFYQQKPGKAPKLLIYAASSLQSGVPSRFSGSGSGTDFTLTISSLQPEDFATYYCQQSYSTPLTFGGGTKVEIK

SEQ ID NO: 113 - protein, 107 aa, Artificial [sequence omitted]

SEQ ID NO: 114 - protein, 107 aa, Artificial [sequence omitted]

SEQ ID NO: 115 - protein, 107 aa, Artificial [sequence omitted]

SEQ ID NO: 116 - protein, 107 aa, Artificial
  Synthetic
DIQMTQSPSSLSASVGDRVTITCRASQSISSYANWYQQKPGKAPKLVIYGNSSRESGVPSRFSGSGSGTDFTLTISSLQPEDFATYYCQQSGDSNLTFGGGTKVEIK

SEQ ID NO: 117 - protein, 107 aa, Artificial [sequence omitted]

SEQ ID NO: 118 - protein, 107 aa, Artificial [sequence omitted]

SEQ ID NO: 119 - protein, 107 aa, Artificial [sequence omitted]

SEQ ID NO: 120 - protein, 107 aa, Artificial [sequence omitted]

SEQ ID NO: 121 - protein, 107 aa, Artificial [sequence omitted]

SEQ ID NO: 122 - protein, 107 aa, Artificial
  Synthetic
DIQMTQSPSSLSASVGDRVTITCRASQSISYYVNWYQQKPGKAPKLLIYAASSLQSGVPSRFSGSGSGTDFTLTISSLQPEDFATYYCQQSYSTPLTFGGGTKVEIK

SEQ ID NO: 123 - protein, 107 aa, Artificial; identical to SEQ ID NO: 98
  Synthetic

SEQ ID NO: 124 - protein, 107 aa, Artificial [sequence omitted]

SEQ ID NO: 125 - protein, 107 aa, Artificial
  Synthetic
DIQMTQSPSSLSASVGDRVTITCRASQSISSYANWYQQKPGKAPKLLIYAASSLQSGVPSRFSGSGSGTDFTLTISSLQPEDFATYYCQQSYSTPLTFGGGTKVEIK

SEQ ID NO: 126 - protein, 107 aa, Artificial; identical to SEQ ID NO: 125
  Synthetic

SEQ ID NO: 127 - protein, 107 aa, Artificial; identical to SEQ ID NO: 98
  Synthetic

SEQ ID NO: 128 - protein, 107 aa, Artificial; identical to SEQ ID NO: 98
  Synthetic

SEQ ID NO: 129 - protein, 107 aa, Artificial; identical to SEQ ID NO: 98
  Synthetic

SEQ ID NO: 130 - protein, 107 aa, Artificial; identical to SEQ ID NO: 98
  Synthetic

SEQ ID NO: 131 - protein, 107 aa, Artificial
  Synthetic
DIQMTQSPSSLSASVGDRVTITCRASQSISSYVAWYQQKPGKAPKLLIYGNTSLQSGVPSRFSGSGSGTDFTLTISSLQPEDFATYYCQQGDENPLTFGGGTKVEIK

SEQ ID NO: 132 - protein, 107 aa, Artificial [sequence omitted]

SEQ ID NO: 133 - protein, 107 aa, Artificial [sequence omitted]

SEQ ID NO: 134 - protein, 107 aa, Artificial [sequence omitted]

SEQ ID NO: 135 - protein, 107 aa, Artificial [sequence omitted]

SEQ ID NO: 136 - protein, 107 aa, Artificial [sequence omitted]

SEQ ID NO: 137 - protein, 107 aa, Artificial [sequence omitted]

SEQ ID NO: 138 - protein, 107 aa, Artificial [sequence omitted]

SEQ ID NO: 139 - protein, 107 aa, Artificial [sequence omitted]

SEQ ID NO: 140 - protein, 107 aa, Artificial; identical to SEQ ID NO: 98
  Synthetic

SEQ ID NO: 141 - protein, 107 aa, Artificial [sequence omitted]

SEQ ID NO: 142 - protein, 107 aa, Artificial [sequence omitted]

SEQ ID NO: 143 - protein, 107 aa, Artificial [sequence omitted]

SEQ ID NO: 144 - protein, 107 aa, Artificial [sequence omitted]

SEQ ID NO: 145 - protein, 107 aa, Artificial
  Synthetic
DIQMTQSPSSLSASVGDRVTITCRASQSIIYYLNWYQQKPGKAPKLLIYAASSLQSGVPSRFSGSGSGTDFTLTISSLQPEDFATYYCQQSYSTPLTFGGGTKVEIK

SEQ ID NO: 146 - protein, 107 aa, Artificial; identical to SEQ ID NO: 98
  Synthetic

SEQ ID NO: 147 - protein, 107 aa, Artificial [sequence omitted]

SEQ ID NO: 148 - protein, 107 aa, Artificial [sequence omitted]

SEQ ID NO: 149 - protein, 107 aa, Artificial; identical to SEQ ID NO: 98
  Synthetic

SEQ ID NO: 150 - protein, 107 aa, Artificial [sequence omitted]

SEQ ID NO: 151 - protein, 107 aa, Artificial [sequence omitted]

SEQ ID NO: 152 - protein, 107 aa, Artificial [sequence omitted]

SEQ ID NO: 153 - protein, 107 aa, Artificial [sequence omitted]

SEQ ID NO: 154 - protein, 107 aa, Artificial; identical to SEQ ID NO: 98
  Synthetic

SEQ ID NO: 155 - protein, 107 aa, Artificial
  Synthetic
DIQMTQSPSSLSASVGDRVTITCRASQSISYYANWYQQKPGKAPKLLIYAASSLQSGVPSRFSGSGSGTDFTLTISSLQPEDFATYYCQQSYSTPLTFGGGTKVEIK

SEQ ID NO: 156 - protein, 107 aa, Artificial [sequence omitted]

SEQ ID NO: 157 - protein, 107 aa, Artificial [sequence omitted]

SEQ ID NO: 158 - protein, 107 aa, Artificial; identical to SEQ ID NO: 98
  Synthetic

SEQ ID NO: 159 - protein, 107 aa, Artificial; identical to SEQ ID NO: 98
  Synthetic

SEQ ID NO: 160 - protein, 107 aa, Artificial; identical to SEQ ID NO: 98
  Synthetic

SEQ ID NO: 161 - protein, 107 aa, Artificial [sequence omitted]

SEQ ID NO: 162 - protein, 107 aa, Artificial; identical to SEQ ID NO: 98
  Synthetic

SEQ ID NO: 163 - protein, 107 aa, Artificial [sequence omitted]

SEQ ID NO: 164 - protein, 107 aa, Artificial [sequence omitted]

SEQ ID NO: 165 - protein, 107 aa, Artificial [sequence omitted]

SEQ ID NO: 166 - protein, 107 aa, Artificial [sequence omitted]

SEQ ID NO: 167 - protein, 107 aa, Artificial; identical to SEQ ID NO: 98
  Synthetic

SEQ ID NO: 168 - protein, 107 aa, Artificial [sequence omitted]

SEQ ID NO: 169 - protein, 107 aa, Artificial; identical to SEQ ID NO: 98
  Synthetic

SEQ ID NO: 170 - protein, 107 aa, Artificial; identical to SEQ ID NO: 98
  Synthetic

SEQ ID NO: 171 - protein, 107 aa, Artificial [sequence omitted]

SEQ ID NO: 172 - protein, 107 aa, Artificial [sequence omitted]

SEQ ID NO: 173 - protein, 107 aa, Artificial [sequence omitted]

SEQ ID NO: 174 - protein, 107 aa, Artificial [sequence omitted]

SEQ ID NO: 175 - protein, 107 aa, Artificial [sequence omitted]

SEQ ID NO: 176 - protein, 107 aa, Artificial [sequence omitted]

SEQ ID NO: 177 - protein, 107 aa, Artificial [sequence omitted]

SEQ ID NO: 178 - protein, 107 aa, Artificial [sequence omitted]

SEQ ID NO: 179 - protein, 107 aa, Artificial [sequence omitted]

SEQ ID NO: 180 - protein, 107 aa, Artificial
  Synthetic
DIQMTQSPSSLSASVGDRVTITCRASQSISSYVAWYQQKPGKAPKLLIYVNTSRASGVPSRFSGSGSGTDFTLTISSLQPEDFATYYCQQWYEFNLTFGGGTKVEIK

SEQ ID NO: 181 - protein, 107 aa, Artificial [sequence omitted]

SEQ ID NO: 182 - protein, 107 aa, Artificial [sequence omitted]

SEQ ID NO: 183 - protein, 107 aa, Artificial [sequence omitted]

SEQ ID NO: 184 - protein, 107 aa, Artificial [sequence omitted]

SEQ ID NO: 185 - protein, 107 aa, Artificial [sequence omitted]

SEQ ID NO: 186 - protein, 107 aa, Artificial [sequence omitted]

SEQ ID NO: 187 - protein, 107 aa, Artificial [sequence omitted]

SEQ ID NO: 188 - protein, 107 aa, Artificial [sequence omitted]

SEQ ID NO: 189 - protein, 107 aa, Artificial [sequence omitted]

SEQ ID NO: 190 - protein, 107 aa, Artificial [sequence omitted]

SEQ ID NO: 191 - protein, 107 aa, Artificial [sequence omitted]

SEQ ID NO: 192 - protein, 107 aa, Artificial [sequence omitted]

SEQ ID NO: 193 - protein, 107 aa, Artificial [sequence omitted]

SEQ ID NO: 194 - protein, 107 aa, Artificial [sequence omitted]

SEQ ID NO: 195 - protein, 119 aa, Artificial
  Synthetic
EVQLLESGGGLVQPGGSLRLSCAASGFTFSSYGMNWVRQAPGKGLEWVAGINYSSGNKYYADSVKGRFTISRDNSKNTLYLQMNSLRAEDTAVYYCARGPYASTWLDYWGQGTLVTVSS

SEQ ID NO: 196 - protein, 118 aa, Artificial
  Synthetic
EVQLLESGGGLVQPGGSLRLSCAASGFTFSSYSMNWVRQAPGKGLEWVASIKSSSSYTSYADSVKGRFTISRDNSKNTLYLQMNSLRAEDTAVYYCARGPYDTWLDYWGQGTLVTVSS

SEQ ID NO: 197 - protein, 118 aa, Artificial
  Synthetic
EVQLLESGGGLVQPGGSLRLSCAASGFTFSSYSMHWVRQAPGKGLEWVASIKSSGGYKSYADSVKGRFTISRDNSKNTLYLQMNSLRAEDTAVYYCARGPYDVWIDYWGQGTLVTVSS

SEQ ID NO: 198 - protein, 118 aa, Artificial
  Synthetic
EVQLLESGGGLVQPGGSLRLSCAASGFTFSSYTMHWVRQAPGKGLEWVANIKSSSSTKYYADSVKGRFTISRDNSKNTLYLQMNSLRAEDTAVYYCARGPYDVWLDYWGQGTLVTVSS

SEQ ID NO: 199 - protein, 118 aa, Artificial
  Synthetic
EVQLLESGGGLVQPGGSLRLSCAASGFTFSSYSMHWVRQAPGKGLEWVASIKSSSSNKYYADSVKGRFTISRDNSKNTLYLQMNSLRAEDTAVYYCARGPYDVWLDYWGQGTLVTVSS

SEQ ID NO: 200 - protein, 118 aa, Artificial
  Synthetic
EVQLLESGGGLVQPGGSLRLSCAASGFTFSSYGMNWVRQAPGKGLEWVAGIKYSSGNKYYADSVKGRFTISRDNSKNTLYLQMNSLRAEDTAVYYCARGPYDVWMDYWGQGTLVTVSS

SEQ ID NO: 201 - protein, 118 aa, Artificial
  Synthetic
EVQLLESGGGLVQPGGSLRLSCAASGFTFSDYSMNWVRQAPGKGLEWVALIKSNSGSTSYADSVKGRFTISRDNSKNTLYLQMNSLRAEDTAVYYCARGPYDVWMDYWGQGTLVTVSS

SEQ ID NO: 202 - protein, 118 aa, Artificial
  Synthetic
EVQLLESGGGLVQPGGSLRLSCAASGFTFDSYSMHWVRQAPGKGLEWVANIKSSGGYISYADSVKGRFTISRDNSKNTLYLQMNSLRAEDTAVYYCARGPYDVWMDYWGQGTLVTVSS

SEQ ID NO: 203 - protein, 118 aa, Artificial
  Synthetic
EVQLLESGGGLVQPGGSLRLSCAASGFTFSSYSMNWVRQAPGKGLEWVANIKSSGSSTSYADSVKGRFTISRDNSKNTLYLQMNSLRAEDTAVYYCARGPYDVWMDYWGQGTLVTVSS

SEQ ID NO: 204 - protein, 118 aa, Artificial
  Synthetic
EVQLLESGGGLVQPGGSLRLSCAASGFTFDSYGMNWVRQAPGKGLEWVASIKYSSGYKYYADSVKGRFTISRDNSKNTLYLQMNSLRAEDTAVYYCARGPYDVWMDYWGQGTLVTVSS

SEQ ID NO: 205 - protein, 118 aa, Artificial
  Synthetic
EVQLLESGGGLVQPGGSLRLSCAASGFTFSSYSMNWVRQAPGKGLEWVAYIKSNSGTKGYADSVKGRFTISRDNSKNTLYLQMNSLRAEDTAVYYCARGPYDYWLDYWGQGTLVTVSS

SEQ ID NO: 206 - protein, 118 aa, Artificial
  Synthetic
EVQLLESGGGLVQPGGSLRLSCAASGFTFSSYGMNWVRQAPGKGLEWVSDINSNSGSTSYADSVKGRFTISRDNSKNTLYLQMNSLRAEDTAVYYCARGPYGVWLDYWGQGTLVTVSS

SEQ ID NO: 207 - protein, 118 aa, Artificial
  Synthetic
EVQLLESGGGLVQPGGSLRLSCAASGFTFSSYGMHWVRQAPGKGLEWVSDISSNGGTIYYADSVKGRFTISRDNSKNTLYLQMNSLRAEDTAVYYCARGPYGVWLDYWGQGTLVTVSS

SEQ ID NO: 208 - protein, 118 aa, Artificial
  Synthetic
EVQLLESGGGLVQPGGSLRLSCAASGFTFSSYGMHWVRQAPGKGLEWVARINSNGGSKSYADSVKGRFTISRDNSKNTLYLQMNSLRAEDTAVYYCARGPYGYWFDYWGQGTLVTVSS

SEQ ID NO: 209 - protein, 118 aa, Artificial
  Synthetic
EVQLLESGGGLVQPGGSLRLSCAASGFTFSSYGMNWVRQAPGKGLEWVARISSSGSYIGYADSVKGRFTISRDNSKNTLYLQMNSLRAEDTAVYYCARGPYGYWLDYWGQGTLVTVSS

SEQ ID NO: 210 - protein, 107 aa, Artificial [sequence omitted]

SEQ ID NO: 211 - protein, 107 aa, Artificial [sequence omitted]

SEQ ID NO: 212 - protein, 107 aa, Artificial [sequence omitted]

SEQ ID NO: 213 - protein, 107 aa, Artificial [sequence omitted]

SEQ ID NO: 214 - protein, 107 aa, Artificial [sequence omitted]

SEQ ID NO: 215 - protein, 107 aa, Artificial [sequence omitted]

SEQ ID NO: 216 - protein, 107 aa, Artificial [sequence omitted]

SEQ ID NO: 217 - protein, 107 aa, Artificial [sequence omitted]

SEQ ID NO: 218 - protein, 107 aa, Artificial [sequence omitted]

SEQ ID NO: 219 - protein, 107 aa, Artificial [sequence omitted]

SEQ ID NO: 220 - protein, 107 aa, Artificial [sequence omitted]

SEQ ID NO: 221 - protein, 107 aa, Artificial [sequence omitted]

SEQ ID NO: 222 - protein, 107 aa, Artificial [sequence omitted]

SEQ ID NO: 223 - protein, 107 aa, Artificial [sequence omitted]

SEQ ID NO: 224 - protein, 107 aa, Artificial [sequence omitted]

SEQ ID NO: 225 - protein, 118 aa, Artificial
  Synthetic
EVQLLESGGGLVQPGGSLRLSCAASGFTFSSYSMHWVRQAPGKGLEWVSAISSDGSYISYADSVKGRFTISRDNSKNTLYLQMNSLRAEDTAVYYCARVPYDVWFDYWGQGTLVTVSS

SEQ ID NO: 226 - protein, 118 aa, Artificial
  Synthetic
EVQLLESGGGLVQPGGSLRLSCAASGFTFSSYSMHWVRQAPGKGLEWVAAISSNTGSIGYADSVKGRFTISRDNSKNTLYLQMNSLRAEDTAVYYCARVPYDVWIDYWGQGTLVTVSS

SEQ ID NO: 227 - protein, 118 aa, Artificial
  Synthetic
EVQLLESGGGLVQPGGSLRLSCAASGFTFSSYSMHWVRQAPGKGLEWVASIKGNTGSSGYADSVKGRFTISRDNSKNTLYLQMNSLRAEDTAVYYCARVPYDVWIDYWGQGTLVTVSS

SEQ ID NO: 228 - protein, 118 aa, Artificial
  Synthetic
EVQLLESGGGLVQPGGSLRLSCAASGFTFSSYSMHWVRQAPGKGLEWVASIKSNAGTSSYADSVKGRFTISRDNSKNTLYLQMNSLRAEDTAVYYCARVPYDVWIDYWGQGTLVTVSS

SEQ ID NO: 229 - protein, 118 aa, Artificial
  Synthetic
EVQLLESGGGLVQPGGSLRLSCAASGFTFSSYSMHWVRQAPGKGLEWVASISSNAGYSSYADSVKGRFTISRDNSKNTLYLQMNSLRAEDTAVYYCARVPYDVWIDYWGQGTLVTVSS

SEQ ID NO: 230 - protein, 118 aa, Artificial
  Synthetic
EVQLLESGGGLVQPGGSLRLSCAASGFTFSSYSMSWVRQAPGKGLEWVASISSSAGYSYYADSVKGRFTISRDNSKNTLYLQMNSLRAEDTAVYYCARVPYDVWIDYWGQGTLVTVSS

SEQ ID NO: 231 - protein, 118 aa, Artificial
  Synthetic
EVQLLESGGGLVQPGGSLRLSCAASGFTFSSYSMHWVRQAPGKGLEWVAYIKSDTSTIGYADSVKGRFTISRDNSKNTLYLQMNSLRAEDTAVYYCARVPYDVWIDYWGQGTLVTVSS

SEQ ID NO: 232 - protein, 118 aa, Artificial
  Synthetic
EVQLLESGGGLVQPGGSLRLSCAASGFTFSSYAMHWVRQAPGKGLEWVSSISSDTGYIGYADSVKGRFTISRDNSKNTLYLQMNSLRAEDTAVYYCARVPYDVWIDYWGQGTLVTVSS

SEQ ID NO: 233 - protein, 118 aa, Artificial
  Synthetic
EVQLLESGGGLVQPGGSLRLSCAASGFTFSSYSMSWVRQAPGKGLEWVASIKGSAGSSSYADSVKGRFTISRDNSKNTLYLQMNSLRAEDTAVYYCARVPYDVWLDYWGQGTLVTVSS

SEQ ID NO: 234 - protein, 118 aa, Artificial
  Synthetic
EVQLLESGGGLVQPGGSLRLSCAASGFTFSSYSMHWVRQAPGKGLEWVSSISSSAGYTSYADSVKGRFTISRDNSKNTLYLQMNSLRAEDTAVYYCARVPYDVWLDYWGQGTLVTVSS

SEQ ID NO: 235 - protein, 118 aa, Artificial
  Synthetic
EVQLLESGGGLVQPGGSLRLSCAASGFTFSSYSMHWVRQAPGKGLEWVANINSNGGNTGYADSVKGRFTISRDNSKNTLYLQMNSLRAEDTAVYYCARVPYDVWMDYWGQGTLVTVSS

SEQ ID NO: 236 - protein, 118 aa, Artificial; identical to SEQ ID NO: 235
  Synthetic

SEQ ID NO: 237 - protein, 118 aa, Artificial
  Synthetic
EVQLLESGGGLVQPGGSLRLSCAASGFTFSSYSMHWVRQAPGKGLEWVASISGSTSSSSYADSVKGRFTISRDNSKNTLYLQMNSLRAEDTAVYYCARVPYDVWMDYWGQGTLVTVSS

SEQ ID NO: 238 - protein, 118 aa, Artificial
  Synthetic
EVQLLESGGGLVQPGGSLRLSCAASGFTFSSYGMHWVRQAPGKGLEWVSSISSSGGTKGYADSVKGRFTISRDNSKNTLYLQMNSLRAEDTAVYYCARVPYDVWMDYWGQGTLVTVSS

SEQ ID NO: 239 - protein, 118 aa, Artificial
  Synthetic
EVQLLESGGGLVQPGGSLRLSCAASGFTFSSYSMHWVRQAPGKGLEWVTSISSNAGYISYADSVKGRFTISRDNSKNTLYLQMNSLRAEDTAVYYCARVPYDVWMDYWGQGTLVTVSS

SEQ ID NO: 240 - protein, 118 aa, Artificial
  Synthetic
EVQLLESGGGLVQPGGSLRLSCAASGFTFSSYSMHWVRQAPGKGLEWVAAIKSDAGTSGYADSVKGRFTISRDNSKNTLYLQMNSLRAEDTAVYYCARVPYDYWIDYWGQGTLVTVSS

SEQ ID NO: 241 - protein, 118 aa, Artificial
  Synthetic
EVQLLESGGGLVQPGGSLRLSCAASGFTFSSYSMHWVRQAPGKGLEWVASIKGNTGSISYADSVKGRFTISRDNSKNTLYLQMNSLRAEDTAVYYCARVPYDYWIDYWGQGTLVTVSS

SEQ ID NO: 242 - protein, 118 aa, Artificial
  Synthetic
EVQLLESGGGLVQPGGSLRLSCAASGFTFSSYSMNWVRQAPGKGLEWVASIKGSASYTSYADSVKGRFTISRDNSKNTLYLQMNSLRAEDTAVYYCARVPYDYWIDYWGQGTLVTVSS

SEQ ID NO: 243 - protein, 118 aa, Artificial
  Synthetic
EVQLLESGGGLVQPGGSLRLSCAASGFTFSSYSMHWVRQAPGKGLEWVASIKSDTSSTYYADSVKGRFTISRDNSKNTLYLQMNSLRAEDTAVYYCARVPYDYWIDYWGQGTLVTVSS

SEQ ID NO: 244 - protein, 118 aa, Artificial
  Synthetic
EVQLLESGGGLVQPGGSLRLSCAASGFTFSSYSMSWVRQAPGKGLEWVASIKSSAGYISYADSVKGRFTISRDNSKNTLYLQMNSLRAEDTAVYYCARVPYDYWIDYWGQGTLVTVSS

SEQ ID NO: 245 - protein, 118 aa, Artificial
  Synthetic
EVQLLESGGGLVQPGGSLRLSCAASGFTFSSYSMHWVRQAPGKGLEWVASISSNAGTTGYADSVKGRFTISRDNSKNTLYLQMNSLRAEDTAVYYCARVPYDYWIDYWGQGTLVTVSS

SEQ ID NO: 246 - protein, 118 aa, Artificial
  Synthetic
EVQLLESGGGLVQPGGSLRLSCAASGFTFSSYSMHWVRQAPGKGLEWVSSIKSSAGYTYYADSVKGRFTISRDNSKNTLYLQMNSLRAEDTAVYYCARVPYDYWIDYWGQGTLVTVSS

SEQ ID NO: 247 - protein, 118 aa, Artificial
  Synthetic
EVQLLESGGGLVQPGGSLRLSCAASGFTFSSYSMHWVRQAPGKGLEWVSSINSNAGTISYADSVKGRFTISRDNSKNTLYLQMNSLRAEDTAVYYCARVPYDYWIDYWGQGTLVTVSS

SEQ ID NO: 248 - protein, 118 aa, Artificial
  Synthetic
EVQLLESGGGLVQPGGSLRLSCAASGFTFSSYSMNWVRQAPGKGLEWVSSINSNAGTIYYADSVKGRFTISRDNSKNTLYLQMNSLRAEDTAVYYCARVPYDYWIDYWGQGTLVTVSS

SEQ ID NO: 249 - protein, 118 aa, Artificial
  Synthetic
EVQLLESGGGLVQPGGSLRLSCAASGFTFDSYSMHWVRQAPGKGLEWVSSINSNGGYKYYADSVKGRFTISRDNSKNTLYLQMNSLRAEDTAVYYCARVPYDYWIDYWGQGTLVTVSS

SEQ ID NO: 250 - protein, 118 aa, Artificial
  Synthetic
EVQLLESGGGLVQPGGSLRLSCAASGFTFSSYSMNWVRQAPGKGLEWVTSISSSASTTGYADSVKGRFTISRDNSKNTLYLQMNSLRAEDTAVYYCARVPYDYWIDYWGQGTLVTVSS

SEQ ID NO: 251 - protein, 118 aa, Artificial
  Synthetic
EVQLLESGGGLVQPGGSLRLSCAASGFTFSSYSMHWVRQAPGKGLEWVAAIKSSGSSTSYADSVKGRFTISRDNSKNTLYLQMNSLRAEDTAVYYCARVPYDYWLDYWGQGTLVTVSS

SEQ ID NO: 252 - protein, 118 aa, Artificial
  Synthetic
EVQLLESGGGLVQPGGSLRLSCAASGFTFSSYSMSWVRQAPGKGLEWVASINSNAGTISYADSVKGRFTISRDNSKNTLYLQMNSLRAEDTAVYYCARVPYDYWLDYWGQGTLVTVSS

SEQ ID NO: 253 - protein, 118 aa, Artificial
  Synthetic
EVQLLESGGGLVQPGGSLRLSCAASGFTFSSYSMHWVRQAPGKGLEWVSSISSSAGTSGYADSVKGRFTISRDNSKNTLYLQMNSLRAEDTAVYYCARVPYDYWLDYWGQGTLVTVSS

SEQ ID NO: 254 - protein, 118 aa, Artificial
  Synthetic
EVQLLESGGGLVQPGGSLRLSCAASGFTFSSYSMHWVRQAPGKGLEWVAAIKSNGGYIYYADSVKGRFTISRDNSKNTLYLQMNSLRAEDTAVYYCARVPYDYWMDYWGQGTLVTVSS

SEQ ID NO: 255 - protein, 118 aa, Artificial
  Synthetic
EVQLLESGGGLVQPGGSLRLSCAASGFTFSSYAMHWVRQAPGKGLEWVAAISSNTGYIYYADSVKGRFTISRDNSKNTLYLQMNSLRAEDTAVYYCARVPYDYWMDYWGQGTLVTVSS

SEQ ID NO: 256 - protein, 118 aa, Artificial
  Synthetic
EVQLLESGGGLVQPGGSLRLSCAASGFTFSSYSMSWVRQAPGKGLEWVAAISSSASTTSYADSVKGRFTISRDNSKNTLYLQMNSLRAEDTAVYYCARVPYDYWMDYWGQGTLVTVSS

SEQ ID NO: 257 - protein, 118 aa, Artificial
  Synthetic
EVQLLESGGGLVQPGGSLRLSCAASGFTFSDYGMHWVRQAPGKGLEWVAGIWYNGGYKSYADSVKGRFTISRDNSKNTLYLQMNSLRAEDTAVYYCARVPYDYWMDYWGQGTLVTVSS

SEQ ID NO: 258 - protein, 118 aa, Artificial
  Synthetic
EVQLLESGGGLVQPGGSLRLSCAASGFTFSSYSMSWVRQAPGKGLEWVASIKGSAGYIYYADSVKGRFTISRDNSKNTLYLQMNSLRAEDTAVYYCARVPYDYWMDYWGQGTLVTVSS

SEQ ID NO: 259 - protein, 118 aa, Artificial
  Synthetic
EVQLLESGGGLVQPGGSLRLSCAASGFTFSSYSMHWVRQAPGKGLEWVASIKGSASYSYYADSVKGRFTISRDNSKNTLYLQMNSLRAEDTAVYYCARVPYDYWMDYWGQGTLVTVSS

SEQ ID NO: 260 - protein, 118 aa, Artificial
  Synthetic
EVQLLESGGGLVQPGGSLRLSCAASGFTFSSYSMHWVRQAPGKGLEWVASIKSSGGSKYYADSVKGRFTISRDNSKNTLYLQMNSLRAEDTAVYYCARVPYDYWMDYWGQGTLVTVSS

SEQ ID NO: 261 - protein, 118 aa, Artificial
  Synthetic
EVQLLESGGGLVQPGGSLRLSCAASGFTFSSYSMHWVRQAPGKGLEWVASIKSSGGYISYADSVKGRFTISRDNSKNTLYLQMNSLRAEDTAVYYCARVPYDYWMDYWGQGTLVTVSS

SEQ ID NO: 262 - protein, 118 aa, Artificial
  Synthetic
EVQLLESGGGLVQPGGSLRLSCAASGFTFSSYSMSWVRQAPGKGLEWVASIKSSTGTISYADSVKGRFTISRDNSKNTLYLQMNSLRAEDTAVYYCARVPYDYWMDYWGQGTLVTVSS

SEQ ID NO: 263 - protein, 118 aa, Artificial
  Synthetic
EVQLLESGGGLVQPGGSLRLSCAASGFTFSSYSMNWVRQAPGKGLEWVASINSNAGSTYYADSVKGRFTISRDNSKNTLYLQMNSLRAEDTAVYYCARVPYDYWMDYWGQGTLVTVSS

SEQ ID NO: 264 - protein, 118 aa, Artificial
  Synthetic
  misc_feature (35)..(35): Xaa can be any naturally occurring amino acid
EVQLLESGGGLVQPGGSLRLSCAASGFTFSSYSMXWVRQAPGKGLEWVASISSSGGSIYYADSVKGRFTISRDNSKNTLYLQMNSLRAEDTAVYYCARVPYDYWMDYWGQGTLVTVSS

SEQ ID NO: 265 - protein, 118 aa, Artificial
  Synthetic
EVQLLESGGGLVQPGGSLRLSCAASGFTFSSYSMHWVRQAPGKGLEWVASIWSNSGNTGYADSVKGRFTISRDNSKNTLYLQMNSLRAEDTAVYYCARVPYDYWMDYWGQGTLVTVSS

SEQ ID NO: 266 - protein, 118 aa, Artificial
  Synthetic
EVQLLESGGGLVQPGGSLRLSCAASGFTFSSYSMHWVRQAPGKGLEWVSSIKSSASYSSYADSVKGRFTISRDNSKNTLYLQMNSLRAEDTAVYYCARVPYDYWMDYWGQGTLVTVSS

SEQ ID NO: 267 - protein, 118 aa, Artificial
  Synthetic
EVQLLESGGGLVQPGGSLRLSCAASGFTFSSYAMHWVRQAPGKGLEWVAAIKSSAGYSYYADSVKGRFTISRDNSKNTLYLQMNSLRAEDTAVYYCARVPYGVWIDYWGQGTLVTVSS

SEQ ID NO: 268 - protein, 118 aa, Artificial
  Synthetic
EVQLLESGGGLVQPGGSLRLSCAASGFTFSSYAMHWVRQAPGKGLEWVADIKSNTGYTYYADSVKGRFTISRDNSKNTLYLQMNSLRAEDTAVYYCARVPYGVWIDYWGQGTLVTVSS

SEQ ID NO: 269 - protein, 118 aa, Artificial
  Synthetic
EVQLLESGGGLVQPGGSLRLSCAASGFTFSSYAMSWVRQAPGKGLEWVASIKSSTGYTYYADSVKGRFTISRDNSKNTLYLQMNSLRAEDTAVYYCARVPYGVWIDYWGQGTLVTVSS

SEQ ID NO: 270 - protein, 118 aa, Artificial
  Synthetic
EVQLLESGGGLVQPGGSLRLSCAASGFTFSSYAMHWVRQAPGKGLEWVASISGNAGSSSYADSVKGRFTISRDNSKNTLYLQMNSLRAEDTAVYYCARVPYGVWIDYWGQGTLVTVSS

SEQ ID NO: 271 - protein, 118 aa, Artificial; identical to SEQ ID NO: 270
  Synthetic

SEQ ID NO: 272 - protein, 118 aa, Artificial
  Synthetic
EVQLLESGGGLVQPGGSLRLSCAASGFTFSSYSMSWVRQAPGKGLEWVASISSSAGTTSYADSVKGRFTISRDNSKNTLYLQMNSLRAEDTAVYYCARVPYGVWIDYWGQGTLVTVSS

SEQ ID NO: 273 - protein, 118 aa, Artificial
  Synthetic
EVQLLESGGGLVQPGGSLRLSCAASGFTFSSYSMHWVRQAPGKGLEWVASISSSASTSGYADSVKGRFTISRDNSKNTLYLQMNSLRAEDTAVYYCARVPYGVWIDYWGQGTLVTVSS

SEQ ID NO: 274 - protein, 118 aa, Artificial
  Synthetic
EVQLLESGGGLVQPGGSLRLSCAASGFTFSSYSMHWVRQAPGKGLEWVASISSSASTSYYADSVKGRFTISRDNSKNTLYLQMNSLRAEDTAVYYCARVPYGVWIDYWGQGTLVTVSS

SEQ ID NO: 275 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARVPYGVWIDYWGQGTLVTVSS

SEQ ID NO: 276 - protein, 118 aa, Artificial
  Synthetic
EVQLLESGGGLVQPGGSLRLSCAASGFTFSSYAMNWVRQAPGKGLEWVAAISGNAGSSSYADSVKGRFTISRDNSKNTLYLQMNSLRAEDTAVYYCARVPYGVWLDYWGQGTLVTVSS

SEQ ID NO: 277 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARVPYGVWLDYWGQGTLVTVSS

SEQ ID NO: 278 - protein, 118 aa, Artificial
  Synthetic
EVQLLESGGGLVQPGGSLRLSCAASGFTFSSYSMHWVRQAPGKGLEWVAAIKGNTGSTYYADSVKGRFTISRDNSKNTLYLQMNSLRAEDTAVYYCARVPYGVWMDYWGQGTLVTVSS

SEQ ID NO: 279 - protein, 118 aa, Artificial
  Synthetic
EVQLLESGGGLVQPGGSLRLSCAASGFTFSSYSMHWVRQAPGKGLEWVAAINSNAGSSSYADSVKGRFTISRDNSKNTLYLQMNSLRAEDTAVYYCARVPYGVWMDYWGQGTLVTVSS

SEQ ID NO: 280 - protein, 118 aa, Artificial
  Synthetic
EVQLLESGGGLVQPGGSLRLSCAASGFTFSSYSMHWVRQAPGKGLEWVAGIWSSGGTTSYADSVKGRFTISRDNSKNTLYLQMNSLRAEDTAVYYCARVPYGVWMDYWGQGTLVTVSS

SEQ ID NO: 281 - protein, 118 aa, Artificial
  Synthetic
EVQLLESGGGLVQPGGSLRLSCAASGFTFSSYSMHWVRQAPGKGLEWVAYIKGSAGSTSYADSVKGRFTISRDNSKNTLYLQMNSLRAEDTAVYYCARVPYGVWMDYWGQGTLVTVSS

SEQ ID NO: 282 - protein, 118 aa, Artificial
  Synthetic
EVQLLESGGGLVQPGGSLRLSCAASGFTFSSYSMHWVRQAPGKGLEWVSAINSNAGSSSYADSVKGRFTISRDNSKNTLYLQMNSLRAEDTAVYYCARVPYGVWMDYWGQGTLVTVSS

SEQ ID NO: 283 - protein, 118 aa, Artificial
  Synthetic
EVQLLESGGGLVQPGGSLRLSCAASGFTFSSYAMSWVRQAPGKGLEWVSYISGNAGYISYADSVKGRFTISRDNSKNTLYLQMNSLRAEDTAVYYCARVPYGVWMDYWGQGTLVTVSS

SEQ ID NO: 284 - protein, 118 aa, Artificial
  Synthetic
EVQLLESGGGLVQPGGSLRLSCAASGFTFSSYSMHWVRQAPGKGLEWVASISGSTGTSYYADSVKGRFTISRDNSKNTLYLQMNSLRAEDTAVYYCARVPYGYWIDYWGQGTLVTVSS

SEQ ID NO: 285 - protein, 118 aa, Artificial
  Synthetic
EVQLLESGGGLVQPGGSLRLSCAASGFTFSSYGMHWVRQAPGKGLEWVASISSNGGYTSYADSVKGRFTISRDNSKNTLYLQMNSLRAEDTAVYYCARVPYGYWIDYWGQGTLVTVSS

SEQ ID NO: 286 - protein, 118 aa, Artificial
  Synthetic
EVQLLESGGGLVQPGGSLRLSCAASGFTFSSYSMHWVRQAPGKGLEWVASISSNTGTTGYADSVKGRFTISRDNSKNTLYLQMNSLRAEDTAVYYCARVPYGYWIDYWGQGTLVTVSS

SEQ ID NO: 287 - protein, 118 aa, Artificial
  Synthetic
EVQLLESGGGLVQPGGSLRLSCAASGFTFSSYAMHWVRQAPGKGLEWVTSISSSTGYISYADSVKGRFTISRDNSKNTLYLQMNSLRAEDTAVYYCARVPYGYWIDYWGQGTLVTVSS

SEQ ID NO: 288 - protein, 118 aa, Artificial
  Synthetic
EVQLLESGGGLVQPGGSLRLSCAASGFTFSSYAMSWVRQAPGKGLEWVADIKSNGGYTYYADSVKGRFTISRDNSKNTLYLQMNSLRAEDTAVYYCARVPYGYWLDYWGQGTLVTVSS

SEQ ID NO: 289 - protein, 118 aa, Artificial
  Synthetic
EVQLLESGGGLVQPGGSLRLSCAASGFTFSSYAMSWVRQAPGKGLEWVADISGSAGTISYADSVKGRFTISRDNSKNTLYLQMNSLRAEDTAVYYCARVPYGYWLDYWGQGTLVTVSS

SEQ ID NO: 290 - protein, 118 aa, Artificial
  Synthetic
EVQLLESGGGLVQPGGSLRLSCAASGFTFSSYGMHWVRQAPGKGLEWVAAIKSSGSSTSYADSVKGRFTISRDNSKNTLYLQMNSLRAEDTAVYYCARVPYGYWMDYWGQGTLVTVSS

SEQ ID NO: 291 - protein, 118 aa, Artificial
  Synthetic
EVQLLESGGGLVQPGGSLRLSCAASGFTFSSYSMHWVRQAPGKGLEWVASIKSNTGTTGYADSVKGRFTISRDNSKNTLYLQMNSLRAEDTAVYYCARVPYGYWMDYWGQGTLVTVSS

SEQ ID NO: 292 - protein, 118 aa, Artificial
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARVPYGYWMDYWGQGTLVTVSS

SEQ ID NO: 293 - protein, 118 aa, Artificial
  Synthetic
EVQLLESGGGLVQPGGSLRLSCAASGFTFSSYSMHWVRQAPGKGLEWVSAISGSGGSTYYADSVKGRFTISRDNSKNTLYLQMNSLRAEDTAVYYCARVPYGYWMDYWGQGTLVTVSS

SEQ ID NO: 294 - protein, 118 aa, Artificial
  Synthetic
EVQLLESGGGLVQPGGSLRLSCAASGFTFSSYAMSWVRQAPGKGLEWVSSINSNAGTSYYADSVKGRFTISRDNSKNTLYLQMNSLRAEDTAVYYCARVPYGYWMDYWGQGTLVTVSS

SEQ ID NO: 295 - protein, 118 aa, Artificial
  Synthetic
EVQLLESGGGLVQPGGSLRLSCAASGFTFSSYAMSWVRQAPGKGLEWVSSISSNTGTISYADSVKGRFTISRDNSKNTLYLQMNSLRAEDTAVYYCARVPYGYWMDYWGQGTLVTVSS

SEQ ID NO: 296 - protein, 118 aa, Artificial
  Synthetic
EVQLLESGGGLVQPGGSLRLSCAASGFTFSSYTMSWVRQAPGKGLEWVAGIWSDSGNKGYADSVKGRFTISRDNSKNTLYLQMNSLRAEDTAVYYCARVPYSVWIDYWGQGTLVTVSS

SEQ ID NO: 297 - protein, 118 aa, Artificial
  Synthetic
EVQLLESGGGLVQPGGSLRLSCAASGFTFDSYSMHWVRQAPGKGLEWVSAISGSGGSTYYADSVKGRFTISRDNSKNTLYLQMNSLRAEDTAVYYCARVPYSVWIDYWGQGTLVTVSS

SEQ ID NO: 298 - protein, 118 aa, Artificial
  Synthetic
EVQLLESGGGLVQPGGSLRLSCAASGFTFSSYAMSWVRQAPGKGLEWVSDIKSSAGSTSYADSVKGRFTISRDNSKNTLYLQMNSLRAEDTAVYYCARVPYSVWIDYWGQGTLVTVSS

SEQ ID NO: 299 - protein, 118 aa, Artificial
  Synthetic
EVQLLESGGGLVQPGGSLRLSCAASGFTFSSYAMHWVRQAPGKGLEWVSGISSNGGSTSYADSVKGRFTISRDNSKNTLYLQMNSLRAEDTAVYYCARVPYSVWIDYWGQGTLVTVSS

SEQ ID NO: 300 - protein, 118 aa, Artificial
  Synthetic
EVQLLESGGGLVQPGGSLRLSCAASGFTFSSYAMSWVRQAPGKGLEWVASIKSSTGTTYYADSVKGRFTISRDNSKNTLYLQMNSLRAEDTAVYYCARVPYSVWLDYWGQGTLVTVSS

SEQ ID NO: 301 - protein, 118 aa, Artificial
  Synthetic
EVQLLESGGGLVQPGGSLRLSCAASGFTFSSYAMNWVRQAPGKGLEWVASISSNTGTIGYADSVKGRFTISRDNSKNTLYLQMNSLRAEDTAVYYCARVPYSVWLDYWGQGTLVTVSS

SEQ ID NO: 302 - protein, 118 aa, Artificial
  Synthetic
EVQLLESGGGLVQPGGSLRLSCAASGFTFNSYAMHWVRQAPGKGLEWVAYISGNAGSIYYADSVKGRFTISRDNSKNTLYLQMNSLRAEDTAVYYCARVPYSVWLDYWGQGTLVTVSS

SEQ ID NO: 303 - protein, 118 aa, Artificial
  Synthetic
EVQLLESGGGLVQPGGSLRLSCAASGFTFSSYGMHWVRQAPGKGLEWVASIKSNSGNTGYADSVKGRFTISRDNSKNTLYLQMNSLRAEDTAVYYCARVPYSVWMDYWGQGTLVTVSS

SEQ ID NO: 304 - protein, 118 aa, Artificial
  Synthetic
EVQLLESGGGLVQPGGSLRLSCAASGFTFSSYAMSWVRQAPGKGLEWVASISSSTGTISYADSVKGRFTISRDNSKNTLYLQMNSLRAEDTAVYYCARVPYSVWMDYWGQGTLVTVSS

SEQ ID NO: 305 - protein, 118 aa, Artificial
  Synthetic
EVQLLESGGGLVQPGGSLRLSCAASGFTFSSYSMHWVRQAPGKGLEWVSAISGSGGSTYYADSVKGRFTISRDNSKNTLYLQMNSLRAEDTAVYYCARVPYSVWMDYWGQGTLVTVSS

SEQ ID NO: 306 - protein, 118 aa, Artificial
  Synthetic
EVQLLESGGGLVQPGGSLRLSCAASGFTFSSYAMSWVRQAPGKGLEWVSSISSSASYTGYADSVKGRFTISRDNSKNTLYLQMNSLRAEDTAVYYCARVPYSYWIDYWGQGTLVTVSS

SEQ ID NO: 307 - protein, 118 aa, Artificial
  Synthetic
EVQLLESGGGLVQPGGSLRLSCAASGFTFSSYAMSWVRQAPGKGLEWVASISSNTGSIYYADSVKGRFTISRDNSKNTLYLQMNSLRAEDTAVYYCARVPYSYWLDYWGQGTLVTVSS

SEQ ID NO: 308 - protein, 118 aa, Artificial
  Synthetic
EVQLLESGGGLVQPGGSLRLSCAASGFTFSSYGMHWVRQAPGKGLEWVASISSSSGYKYYADSVKGRFTISRDNSKNTLYLQMNSLRAEDTAVYYCARVPYSYWMDYWGQGTLVTVSS

SEQ ID NO: 309 - protein, 118 aa, Artificial
  Synthetic
EVQLLESGGGLVQPGGSLRLSCAASGFTFSSYAMHWVRQAPGKGLEWVASISSSTGSIGYADSVKGRFTISRDNSKNTLYLQMNSLRAEDTAVYYCARVPYSYWMDYWGQGTLVTVSS

SEQ ID NO: 310 - protein, 118 aa, Artificial
  Synthetic
EVQLLESGGGLVQPGGSLRLSCAASGFTFSSYSMHWVRQAPGKGLEWVASIKGNAGTTYYADSVKGRFTISRDNSKNTLYLQMNSLRAEDTAVYYCAKVPYDVWMDYWGQGTLVTVSS

SEQ ID NO: 311 - protein, 107 aa, Artificial [sequence omitted]

SEQ ID NO: 312 - protein, 107 aa, Artificial [sequence omitted]

SEQ ID NO: 313 - protein, 107 aa, Artificial [sequence omitted]

SEQ ID NO: 314 - protein, 107 aa, Artificial [sequence omitted]

SEQ ID NO: 315 - protein, 107 aa, Artificial [sequence omitted]

SEQ ID NO: 316 - protein, 107 aa, Artificial [sequence omitted]

SEQ ID NO: 317 - protein, 107 aa, Artificial [sequence omitted]

SEQ ID NO: 318 - protein, 107 aa, Artificial; identical to SEQ ID NO: 122
  Synthetic

SEQ ID NO: 319 - protein, 107 aa, Artificial [sequence omitted]

SEQ ID NO: 320 - protein, 107 aa, Artificial [sequence omitted]

SEQ ID NO: 321 - protein, 107 aa, Artificial [sequence omitted]

SEQ ID NO: 322 - protein, 107 aa, Artificial [sequence omitted]

SEQ ID NO: 323 - protein, 107 aa, Artificial [sequence omitted]

SEQ ID NO: 324 - protein, 107 aa, Artificial [sequence omitted]

SEQ ID NO: 325 - protein, 107 aa, Artificial [sequence omitted]

SEQ ID NO: 326 - protein, 107 aa, Artificial [sequence omitted]

SEQ ID NO: 327 - protein, 107 aa, Artificial [sequence omitted]

SEQ ID NO: 328 - protein, 107 aa, Artificial [sequence omitted]

SEQ ID NO: 329 - protein, 107 aa, Artificial [sequence omitted]

SEQ ID NO: 330 - protein, 107 aa, Artificial [sequence omitted]

SEQ ID NO: 331 - protein, 107 aa, Artificial [sequence omitted]

SEQ ID NO: 332 - protein, 107 aa, Artificial [sequence omitted]

SEQ ID NO: 333 - protein, 107 aa, Artificial [sequence omitted]

SEQ ID NO: 334 - protein, 107 aa, Artificial [sequence omitted]

SEQ ID NO: 335 - protein, 107 aa, Artificial [sequence omitted]

SEQ ID NO: 336 - protein, 107 aa, Artificial [sequence omitted]

SEQ ID NO: 337 - protein, 107 aa, Artificial [sequence omitted]

SEQ ID NO: 338 - protein, 107 aa, Artificial [sequence omitted]

SEQ ID NO: 339 - protein, 107 aa, Artificial [sequence omitted]

SEQ ID NO: 340 - protein, 107 aa, Artificial [sequence omitted]

SEQ ID NO: 341 - protein, 107 aa, Artificial [sequence omitted]

SEQ ID NO: 342 - protein, 107 aa, Artificial [sequence omitted]

SEQ ID NO: 343 - protein, 107 aa, Artificial [sequence omitted]

SEQ ID NO: 344 - protein, 107 aa, Artificial [sequence omitted]

SEQ ID NO: 345 - protein, 107 aa, Artificial [sequence omitted]

SEQ ID NO: 346 - protein, 107 aa, Artificial [sequence omitted]

SEQ ID NO: 347 - protein, 107 aa, Artificial [sequence omitted]

SEQ ID NO: 348 - protein, 107 aa, Artificial [sequence omitted]

SEQ ID NO: 349 - protein, 107 aa, Artificial [sequence omitted]

SEQ ID NO: 350 - protein, 107 aa, Artificial [sequence omitted]

SEQ ID NO: 351 - protein, 107 aa, Artificial [sequence omitted]

SEQ ID NO: 352 - protein, 107 aa, Artificial [sequence omitted]

SEQ ID NO: 353 - protein, 107 aa, Artificial; identical to SEQ ID NO: 98
  Synthetic

SEQ ID NO: 354 - protein, 107 aa, Artificial; identical to SEQ ID NO: 155
  Synthetic

SEQ ID NO: 355 - protein, 107 aa, Artificial; identical to SEQ ID NO: 98
  Synthetic

SEQ ID NO: 356 - protein, 107 aa, Artificial; identical to SEQ ID NO: 98
  Synthetic

SEQ ID NO: 357 - protein, 107 aa, Artificial; identical to SEQ ID NO: 98
  Synthetic

SEQ ID NO: 358 - protein, 107 aa, Artificial [sequence omitted]

SEQ ID NO: 359 - protein, 107 aa, Artificial; identical to SEQ ID NO: 98
  Synthetic

SEQ ID NO: 360 - protein, 107 aa, Artificial [sequence omitted]

SEQ ID NO: 361 - protein, 107 aa, Artificial; identical to SEQ ID NO: 98
  Synthetic

SEQ ID NO: 362 - protein, 107 aa, Artificial [sequence omitted]

SEQ ID NO: 363 - protein, 107 aa, Artificial; identical to SEQ ID NO: 98
  Synthetic

SEQ ID NO: 364 - protein, 107 aa, Artificial [sequence omitted]

SEQ ID NO: 365 - protein, 107 aa, Artificial; identical to SEQ ID NO: 98
  Synthetic

SEQ ID NO: 366 - protein, 107 aa, Artificial [sequence omitted]

SEQ ID NO: 367 - protein, 107 aa, Artificial; identical to SEQ ID NO: 98
  Synthetic

SEQ ID NO: 368 - protein, 107 aa, Artificial; identical to SEQ ID NO: 98
  Synthetic

SEQ ID NO: 369 - protein, 107 aa, Artificial
  Synthetic
DIQMTQSPSSLSASVGDRVTITCRASQSISSYAAWYQQKPGKAPKLLIYGNTSRQSGVPSRFSGSGSGTDFTLTISSLQPEDFATYYCQQYSNSPLTFGGGTKVEIK

SEQ ID NO: 370 - protein, 107 aa, Artificial [sequence omitted]

SEQ ID NO: 371 - protein, 107 aa, Artificial [sequence omitted]

SEQ ID NO: 372 - protein, 107 aa, Artificial [sequence omitted]

SEQ ID NO: 373 - protein, 107 aa, Artificial [sequence omitted]

SEQ ID NO: 374 - protein, 107 aa, Artificial [sequence omitted]

SEQ ID NO: 375 - protein, 107 aa, Artificial [sequence omitted]

SEQ ID NO: 376 - protein, 107 aa, Artificial [sequence omitted]

SEQ ID NO: 377 - protein, 107 aa, Artificial [sequence omitted]

SEQ ID NO: 378 - protein, 107 aa, Artificial [sequence omitted]

SEQ ID NO: 379 - protein, 107 aa, Artificial [sequence omitted]

SEQ ID NO: 380 - protein, 107 aa, Artificial [sequence omitted]

SEQ ID NO: 381 - protein, 107 aa, Artificial [sequence omitted]

SEQ ID NO: 382 - protein, 107 aa, Artificial [sequence omitted]

SEQ ID NO: 383 - protein, 107 aa, Artificial; identical to SEQ ID NO: 98
  Synthetic

SEQ ID NO: 384 - protein, 107 aa, Artificial; identical to SEQ ID NO: 122
  Synthetic

SEQ ID NO: 385 - protein, 107 aa, Artificial [sequence omitted]

SEQ ID NO: 386 - protein, 107 aa, Artificial [sequence omitted]

SEQ ID NO: 387 - protein, 107 aa, Artificial [sequence omitted]

SEQ ID NO: 388 - protein, 107 aa, Artificial; identical to SEQ ID NO: 98
  Synthetic

SEQ ID NO: 389 - protein, 107 aa, Artificial [sequence omitted]

SEQ ID NO: 390 - protein, 107 aa, Artificial [sequence omitted]

SEQ ID NO: 391 - protein, 107 aa, Artificial [sequence omitted]

SEQ ID NO: 392 - protein, 107 aa, Artificial [sequence omitted]

SEQ ID NO: 393 - protein, 107 aa, Artificial [sequence omitted]

SEQ ID NO: 394 - protein, 107 aa, Artificial [sequence omitted]

SEQ ID NO: 395 - protein, 107 aa, Artificial [sequence omitted]

SEQ ID NO: 396 - protein, 107 aa, Artificial [sequence omitted]

SEQ ID NO: 397 - protein, 6 aa, Artificial
  Synthetic
SSYAMS

SEQ ID NO: 398 - protein, 13 aa, Artificial
  Synthetic
WVSSIKSSAGSSY

SEQ ID NO: 399 - protein, 10 aa, Artificial
  Synthetic
AREPYDVWID

SEQ ID NO: 400 - protein, 7 aa, Artificial
  Synthetic
SYYLNWY

SEQ ID NO: 401 - protein, 10 aa, Artificial
  Synthetic
LLIYAASSLQ

SEQ ID NO: 402 - protein, 8 aa, Artificial
  Synthetic
QQSYSTPL

SEQ ID NO: 403 - protein, 6 aa, Artificial
  Synthetic
SSYSMS

SEQ ID NO: 404 - protein, 13 aa, Artificial
  Synthetic
WVAAIKGSTSSSY

SEQ ID NO: 405 - protein, 10 aa, Artificial
  Synthetic
AREPYDVWLD

SEQ ID NO: 406 - protein, 7 aa, Artificial
  Synthetic
SSYLNWY

SEQ ID NO: 407 - protein, 10 aa, Artificial
  Synthetic
LLIYAASSLQ

SEQ ID NO: 408 - protein, 8 aa, Artificial
  Synthetic
QQSYSTPL

SEQ ID NO: 409 - protein, 6 aa, Artificial
  Synthetic
SSYSMS

SEQ ID NO: 410 - protein, 13 aa, Artificial
  Synthetic
WVAAIKSNAGTSS

SEQ ID NO: 411 - protein, 10 aa, Artificial
  Synthetic
AREPYDVWLD

SEQ ID NO: 412 - protein, 7 aa, Artificial
  Synthetic
SSYLNWY

SEQ ID NO: 413 - protein, 10 aa, Artificial
  Synthetic
LLIYAASSLQ

SEQ ID NO: 414 - protein, 8 aa, Artificial
  Synthetic
QQSYSTPL

SEQ ID NO: 415 - protein, 6 aa, Artificial
  Synthetic
SSYAMS

SEQ ID NO: 416 - protein, 13 aa, Artificial
  Synthetic
WVSSISSNTGSIS

SEQ ID NO: 417 - protein, 10 aa, Artificial
  Synthetic
AREPYDVWLD

SEQ ID NO: 418 - protein, 7 aa, Artificial
  Synthetic
SSYLNWY

SEQ ID NO: 419 - protein, 10 aa, Artificial
  Synthetic
LLIYAASSLQ

SEQ ID NO: 420 - protein, 8 aa, Artificial
  Synthetic
QQSYSTPL

SEQ ID NO: 421 - protein, 6 aa, Artificial
  Synthetic
SSYSMS

SEQ ID NO: 422 - protein, 13 aa, Artificial
  Synthetic
WVADISSSASTIG

SEQ ID NO: 423 - protein, 10 aa, Artificial
  Synthetic
AREPYDVWMD

SEQ ID NO: 424 - protein, 7 aa, Artificial
  Synthetic
SYYLNWY

SEQ ID NO: 425 - protein, 10 aa, Artificial
  Synthetic
LLIYAASSLQ

SEQ ID NO: 426 - protein, 8 aa, Artificial
  Synthetic
QQSYSTPL

SEQ ID NO: 427 - protein, 6 aa, Artificial
  Synthetic
SSYSMS

SEQ ID NO: 428 - protein, 13 aa, Artificial
  Synthetic
WVSAISGSGGSTY

SEQ ID NO: 429 - protein, 10 aa, Artificial
  Synthetic
AREPYDVWMD

SEQ ID NO: 430 - protein, 7 aa, Artificial
  Synthetic
SSYLNWY

SEQ ID NO: 431 - protein, 10 aa, Artificial
  Synthetic
LLIYAASSLQ

SEQ ID NO: 432 - protein, 8 aa, Artificial
  Synthetic
QQSYSTPL

SEQ ID NO: 433 - protein, 6 aa, Artificial
  Synthetic
SSYSMS

SEQ ID NO: 434 - protein, 13 aa, Artificial
  Synthetic
WVSSISSNTGTSY

SEQ ID NO: 435 - protein, 10 aa, Artificial
  Synthetic
AREPYDVWMD

SEQ ID NO: 436 - protein, 7 aa, Artificial
  Synthetic
SYYLNWY

SEQ ID NO: 437 - protein, 10 aa, Artificial
  Synthetic
LLIYAASSLQ

SEQ ID NO: 438 - protein, 8 aa, Artificial
  Synthetic
QQSYSTPL

SEQ ID NO: 439 - protein, 6 aa, Artificial
  Synthetic
SSYSMS

SEQ ID NO: 440 - protein, 13 aa, Artificial
  Synthetic
WVSSISSNTGTSY

SEQ ID NO: 441 - protein, 10 aa, Artificial
  Synthetic
AREPYDVWMD

SEQ ID NO: 442 - protein, 7 aa, Artificial
  Synthetic
SYYLNWY

SEQ ID NO: 443 - protein, 10 aa, Artificial
  Synthetic
LLIYAASSLQ

SEQ ID NO: 444 - protein, 8 aa, Artificial
  Synthetic
QQSYSTPL

SEQ ID NO: 445 - protein, 6 aa, Artificial
  Synthetic
SSYSMS

SEQ ID NO: 446 - protein, 13 aa, Artificial
  Synthetic
WVAAISGSAGTSG

SEQ ID NO: 447 - protein, 10 aa, Artificial
  Synthetic
AREPYDYWLD

SEQ ID NO: 448 - protein, 7 aa, Artificial
  Synthetic
SSYLNWY

SEQ ID NO: 449 - protein, 10 aa, Artificial
  Synthetic
LLIYAASSLQ

SEQ ID NO: 450 - protein, 8 aa, Artificial
  Synthetic
QQSYSTPL

SEQ ID NO: 451 - protein, 6 aa, Artificial
  Synthetic
SSYSMS

SEQ ID NO: 452 - protein, 13 aa, Artificial
  Synthetic
WVADIKSSGSTKS

SEQ ID NO: 453 - protein, 10 aa, Artificial
  Synthetic
AREPYDYWMD

SEQ ID NO: 454 - protein, 7 aa, Artificial
  Synthetic
SSYLNWY

SEQ ID NO: 455 - protein, 10 aa, Artificial
  Synthetic
LLIYAASSLQ

SEQ ID NO: 456 - protein, 8 aa, Artificial
  Synthetic
QQSYSTPL

SEQ ID NO: 457 - protein, 6 aa, Artificial
  Synthetic
SSYAMS

SEQ ID NO: 458 - protein, 13 aa, Artificial
  Synthetic
WVSAISGSGGSTY

SEQ ID NO: 459 - protein, 10 aa, Artificial
  Synthetic
AREPYDYWMD

SEQ ID NO: 460 - protein, 7 aa, Artificial
  Synthetic
SSYLNWY

SEQ ID NO: 461 - protein, 10 aa, Artificial
  Synthetic
LLIYAASSLQ

SEQ ID NO: 462 - protein, 8 aa, Artificial
  Synthetic
QQSYSTPL

SEQ ID NO: 463 - protein, 6 aa, Artificial
  Synthetic
SSYAMS

SEQ ID NO: 464 - protein, 13 aa, Artificial
  Synthetic
WVSAISGSGGSTY

SEQ ID NO: 465 - protein, 10 aa, Artificial
  Synthetic
AREPYDYWMD

SEQ ID NO: 466 - protein, 7 aa, Artificial
  Synthetic
SSYLNWY

SEQ ID NO: 467 - protein, 10 aa, Artificial
  Synthetic
LLIYAASSLQ

SEQ ID NO: 468 - protein, 8 aa, Artificial
  Synthetic
QQSYSTPL

SEQ ID NO: 469 - protein, 6 aa, Artificial
  Synthetic
SSYAMS

SEQ ID NO: 470 - protein, 13 aa, Artificial
  Synthetic
WVASINSNGGYKS

SEQ ID NO: 471 - protein, 10 aa, Artificial
  Synthetic
AREPYGTWLD

SEQ ID NO: 472 - protein, 7 aa, Artificial
  Synthetic
SSYLNWY

SEQ ID NO: 473 - protein, 10 aa, Artificial
  Synthetic
LLIYAASSLQ

SEQ ID NO: 474 - protein, 8 aa, Artificial
  Synthetic
QQSYSTPL

SEQ ID NO: 475 - protein, 6 aa, Artificial
  Synthetic
SSYAMS

SEQ ID NO: 476 - protein, 13 aa, Artificial
  Synthetic
WVSAISGSGGSTY

SEQ ID NO: 477 - protein, 10 aa, Artificial
  Synthetic
AREPYGVWID

SEQ ID NO: 478 - protein, 7 aa, Artificial
  Synthetic
SYYLNWY

SEQ ID NO: 479 - protein, 10 aa, Artificial
  Synthetic
LLIYAASSLQ

SEQ ID NO: 480 - protein, 8 aa, Artificial
  Synthetic
QQSYSTPL

SEQ ID NO: 481 - protein, 6 aa, Artificial
  Synthetic
SSYSMN

SEQ ID NO: 482 - protein, 13 aa, Artificial
  Synthetic
WVASIKGSASTIY

SEQ ID NO: 483 - protein, 10 aa, Artificial
  Synthetic
AREPYGVWLD

SEQ ID NO: 484 - protein, 7 aa, Artificial
  Synthetic
SYYVNWF

SEQ ID NO: 485 - protein, 10 aa, Artificial
  Synthetic
LLIYAASSLQ

SEQ ID NO: 486 - protein, 8 aa, Artificial
  Synthetic
QQSYSTPL

SEQ ID NO: 487 - protein, 6 aa, Artificial
  Synthetic
SSYAMS

SEQ ID NO: 488 - protein, 13 aa, Artificial
  Synthetic
WVASIKSNTGSSS

SEQ ID NO: 489 - protein, 10 aa, Artificial
  Synthetic
AREPYGVWLD

SEQ ID NO: 490 - protein, 7 aa, Artificial
  Synthetic
SSYLNWY

SEQ ID NO: 491 - protein, 10 aa, Artificial
  Synthetic
LLIYAASSLQ

SEQ ID NO: 492 - protein, 8 aa, Artificial
  Synthetic
QQSYSTPL

SEQ ID NO: 493 - protein, 6 aa, Artificial
  Synthetic
SSYSMS

SEQ ID NO: 494 - protein, 13 aa, Artificial
  Synthetic
WVASISSSAGTSS

SEQ ID NO: 495 - protein, 10 aa, Artificial
  Synthetic
AREPYGVWLD

SEQ ID NO: 496 - protein, 7 aa, Artificial
  Synthetic
SSYLNWY

SEQ ID NO: 497 - protein, 10 aa, Artificial
  Synthetic
LLIYAASSLQ

SEQ ID NO: 498 - protein, 8 aa, Artificial
  Synthetic
QQSYSTPL

SEQ ID NO: 499 - protein, 6 aa, Artificial
  Synthetic
SSYAMS

SEQ ID NO: 500 - protein, 13 aa, Artificial
  Synthetic
WVAYINSNTGTIY

SEQ ID NO: 501 - protein, 10 aa, Artificial
  Synthetic
AREPYGVWLD

SEQ ID NO: 502 - protein, 7 aa, Artificial
  Synthetic
SSYLNWY

SEQ ID NO: 503 - protein, 10 aa, Artificial
  Synthetic
LLIYAASSLQ

SEQ ID NO: 504 - protein, 8 aa, Artificial
  Synthetic
QQSYSTPL

SEQ ID NO: 505 - protein, 6 aa, Artificial
  Synthetic
SSYAMS

SEQ ID NO: 506 - protein, 13 aa, Artificial
  Synthetic
WVAYISGNTGYIG

SEQ ID NO: 507 - protein, 10 aa, Artificial
  Synthetic
AREPYGVWLD

SEQ ID NO: 508 - protein, 7 aa, Artificial
  Synthetic
SSYANWY

SEQ ID NO: 509 - protein, 10 aa, Artificial
  Synthetic
LVIYGNSSRE

SEQ ID NO: 510 - protein, 8 aa, Artificial
  Synthetic
QQSGDSNL

SEQ ID NO: 511 - protein, 6 aa, Artificial
  Synthetic
SSYAMS

SEQ ID NO: 512 - protein, 13 aa, Artificial
  Synthetic
WVSAISGSGGSTY

SEQ ID NO: 513 - protein, 10 aa, Artificial
  Synthetic
AREPYGVWLD

SEQ ID NO: 514 - protein, 7 aa, Artificial
  Synthetic
SSYLNWY

SEQ ID NO: 515 - protein, 10 aa, Artificial
  Synthetic
LLIYAASSLQ

SEQ ID NO: 516 - protein, 8 aa, Artificial
  Synthetic
QQSYSTPL

SEQ ID NO: 517 - protein, 6 aa, Artificial
  Synthetic
SSYAMS

SEQ ID NO: 518 - protein, 13 aa, Artificial
  Synthetic
WVSAISGSGGSTY

SEQ ID NO: 519 - protein, 10 aa, Artificial
  Synthetic
AREPYGVWLD

SEQ ID NO: 520 - protein, 7 aa, Artificial
  Synthetic
SSYLNWY

SEQ ID NO: 521 - protein, 10 aa, Artificial
  Synthetic
LLIYAASSLQ

SEQ ID NO: 522 - protein, 8 aa, Artificial
  Synthetic
QQSYSTPL

SEQ ID NO: 523 - protein, 6 aa, Artificial
  Synthetic
SSYSMS

SEQ ID NO: 524 - protein, 13 aa, Artificial
  Synthetic
WVSAISSNAGSTS

SEQ ID NO: 525 - protein, 10 aa, Artificial
  Synthetic
AREPYGVWLD

SEQ ID NO: 526 - protein, 7 aa, Artificial
  Synthetic
SSYLNWY

SEQ ID NO: 527 - protein, 10 aa, Artificial
  Synthetic
LLIYAASSLQ

SEQ ID NO: 528 - protein, 8 aa, Artificial
  Synthetic
QQSYSTPL

SEQ ID NO: 529 - protein, 6 aa, Artificial
  Synthetic
SSYSMS

SEQ ID NO: 530 - protein, 13 aa, Artificial
  Synthetic
WVSSINSNAGTTY

SEQ ID NO: 531 - protein, 10 aa, Artificial
  Synthetic
AREPYGVWLD

SEQ ID NO: 532 - protein, 7 aa, Artificial
  Synthetic
SSYLNWY

SEQ ID NO: 533 - protein, 10 aa, Artificial
  Synthetic
LLIYAASSLQ

SEQ ID NO: 534 - protein, 8 aa, Artificial
  Synthetic
QQSYSTPL

SEQ ID NO: 535 - protein, 6 aa, Artificial
  Synthetic
SSYSMS

SEQ ID NO: 536 - protein, 13 aa, Artificial
  Synthetic
WVSSINSNAGTTY

SEQ ID NO: 537 - protein, 10 aa, Artificial
  Synthetic
AREPYGVWLD

SEQ ID NO: 538 - protein, 7 aa, Artificial
  Synthetic
SSYLNWY

SEQ ID NO: 539 - protein, 10 aa, Artificial
  Synthetic
LLIYAASSLQ

SEQ ID NO: 540 - protein, 8 aa, Artificial
  Synthetic
QQSYSTPL

SEQ ID NO: 541 - protein, 6 aa, Artificial
  Synthetic
DSYSMN

SEQ ID NO: 542 - protein, 13 aa, Artificial
  Synthetic
WVAAIKSDASTIG

SEQ ID NO: 543 - protein, 10 aa, Artificial
  Synthetic
AREPYGVWMD

SEQ ID NO: 544 - protein, 7 aa, Artificial
  Synthetic
SYYVNWY

SEQ ID NO: 545 - protein, 10 aa, Artificial
  Synthetic
LLIYAASSLQ

SEQ ID NO: 546 - protein, 8 aa, Artificial
  Synthetic
QQSYSTPL

SEQ ID NO: 547 - protein, 6 aa, Artificial
  Synthetic
SSYSMN

SEQ ID NO: 548 - protein, 13 aa, Artificial
  Synthetic
WVAAISGSTGTIS

SEQ ID NO: 549 - protein, 10 aa, Artificial
  Synthetic
AREPYGVWMD

SEQ ID NO: 550 - protein, 7 aa, Artificial
  Synthetic
SYYLNWY

SEQ ID NO: 551 - protein, 10 aa, Artificial
  Synthetic
LLIYAASSLQ

SEQ ID NO: 552 - protein, 8 aa, Artificial
  Synthetic
QQSYSTPL

SEQ ID NO: 553 - protein, 6 aa, Artificial
  Synthetic
SSYGMN

SEQ ID NO: 554 - protein, 13 aa, Artificial
  Synthetic
WVANINSNSGSIY

SEQ ID NO: 555 - protein, 10 aa, Artificial
  Synthetic
AREPYGVWMD

SEQ ID NO: 556 - protein, 7 aa, Artificial
  Synthetic
SSYLNWY

SEQ ID NO: 557 - protein, 10 aa, Artificial
  Synthetic
LLIYAASSLQ

SEQ ID NO: 558 - protein, 8 aa, Artificial
  Synthetic
QQSYSTPL

SEQ ID NO: 559 - protein, 6 aa, Artificial
  Synthetic
DSYAMN

SEQ ID NO: 560 - protein, 13 aa, Artificial
  Synthetic
WVASINSNTGSIY

SEQ ID NO: 561 - protein, 10 aa, Artificial
  Synthetic
AREPYGVWMD

SEQ ID NO: 562 - protein, 7 aa, Artificial
  Synthetic
SYYANWY

SEQ ID NO: 563 - protein, 10 aa, Artificial
  Synthetic
LLIYAASSLQ

SEQ ID NO: 564 - protein, 8 aa, Artificial
  Synthetic
QQSYSTPL

SEQ ID NO: 565 - protein, 6 aa, Artificial
  Synthetic
DSYAMN

SEQ ID NO: 566 - protein, 13 aa, Artificial
  Synthetic
WVASINSNTGSIY

SEQ ID NO: 567 - protein, 10 aa, Artificial
  Synthetic
AREPYGVWMD

SEQ ID NO: 568 - protein, 7 aa, Artificial
  Synthetic
SYYANWY

SEQ ID NO: 569 - protein, 10 aa, Artificial
  Synthetic
LLIYAASSLQ

SEQ ID NO: 570 - protein, 8 aa, Artificial
  Synthetic
QQSYSTPL

SEQ ID NO: 571 - protein, 6 aa, Artificial
  Synthetic
SSYSMS

SEQ ID NO: 572 - protein, 13 aa, Artificial
  Synthetic
WVSAINGNAGSIG

SEQ ID NO: 573 - protein, 10 aa, Artificial
  Synthetic
AREPYGVWMD

SEQ ID NO: 574 - protein, 7 aa, Artificial
  Synthetic
SYYLNWY

SEQ ID NO: 575 - protein, 10 aa, Artificial
  Synthetic
LLIYAASSLQ

SEQ ID NO: 576 - protein, 8 aa, Artificial
  Synthetic
QQSYSTPL

SEQ ID NO: 577 - protein, 6 aa, Artificial
  Synthetic
SSYAMS

SEQ ID NO: 578 - protein, 13 aa, Artificial
  Synthetic
WVSAISGSGGSTY

SEQ ID NO: 579 - protein, 10 aa, Artificial
  Synthetic
AREPYGVWMD

SEQ ID NO: 580 - protein, 7 aa, Artificial
  Synthetic
SYYLNWY

SEQ ID NO: 581 - protein, 10 aa, Artificial
  Synthetic
LLIYAASSLQ

SEQ ID NO: 582 - protein, 8 aa, Artificial
  Synthetic
QQSYSTPL

SEQ ID NO: 583 - protein, 6 aa, Artificial
  Synthetic
SSYAMS

SEQ ID NO: 584 - protein, 13 aa, Artificial
  Synthetic
WVSYINSNTGSIG

SEQ ID NO: 585 - protein, 10 aa, Artificial
  Synthetic
AREPYGVWMD

SEQ ID NO: 586 - protein, 7 aa, Artificial
  Synthetic
SYYLNWY

SEQ ID NO: 587 - protein, 10 aa, Artificial
  Synthetic
LLIYAASSLQ

SEQ ID NO: 588 - protein, 8 aa, Artificial
  Synthetic
QQSYSTPL

SEQ ID NO: 589 - protein, 6 aa, Artificial
  Synthetic
SSYAMS

SEQ ID NO: 590 - protein, 13 aa, Artificial
  Synthetic
WVSYINSNTGSIG

SEQ ID NO: 591 - protein, 10 aa, Artificial
  Synthetic
AREPYGVWMD

SEQ ID NO: 592 - protein, 7 aa, Artificial
  Synthetic
SYYLNWY

SEQ ID NO: 593 - protein, 10 aa, Artificial
  Synthetic
LLIYAASSLQ

SEQ ID NO: 594 - protein, 8 aa, Artificial
  Synthetic
QQSYSTPL

SEQ ID NO: 595 - protein, 6 aa, Artificial
  Synthetic
SSYSMS

SEQ ID NO: 596 - protein, 13 aa, Artificial
  Synthetic
WVAAIKGSAGTSG

SEQ ID NO: 597 - protein, 10 aa, Artificial
  Synthetic
AREPYGYWLD

SEQ ID NO: 598 - protein, 7 aa, Artificial
  Synthetic
SSYVAWY

SEQ ID NO: 599 - protein, 10 aa, Artificial
  Synthetic
LLIYGNTSLQ

SEQ ID NO: 600 - protein, 8 aa, Artificial
  Synthetic
QQGDENPL

SEQ ID NO: 601 - protein, 6 aa, Artificial
  Synthetic
SSYAMS

SEQ ID NO: 602 - protein, 13 aa, Artificial
  Synthetic
WVASISGNTGTSS

SEQ ID NO: 603 - protein, 10 aa, Artificial
  Synthetic
AREPYGYWLD

SEQ ID NO: 604 - protein, 7 aa, Artificial
  Synthetic
SSYLNWY

SEQ ID NO: 605 - protein, 10 aa, Artificial
  Synthetic
LLIYAASSLQ

SEQ ID NO: 606 - protein, 8 aa, Artificial
  Synthetic
QQSYSTPL

SEQ ID NO: 607 - protein, 6 aa, Artificial
  Synthetic
SSYAMS

SEQ ID NO: 608 - protein, 13 aa, Artificial
  Synthetic
WVSAISGSGGSTY

SEQ ID NO: 609 - protein, 10 aa, Artificial
  Synthetic
AREPYGYWLD

SEQ ID NO: 610 - protein, 7 aa, Artificial
  Synthetic
SSYLNWY

SEQ ID NO: 611 - protein, 10 aa, Artificial
  Synthetic
LLIYAASSLQ

SEQ ID NO: 612 - protein, 8 aa, Artificial
  Synthetic
QQSYSTPL

SEQ ID NO: 613 - protein, 6 aa, Artificial
  Synthetic
SSYAMS

SEQ ID NO: 614 - protein, 13 aa, Artificial
  Synthetic
WVSSIWSNGGSIY

SEQ ID NO: 615 - protein, 10 aa, Artificial
  Synthetic
AREPYGYWLD

SEQ ID NO: 616 - protein, 7 aa, Artificial
  Synthetic
SSYLNWY

SEQ ID NO: 617 - protein, 10 aa, Artificial
  Synthetic
LLIYAASSLQ

SEQ ID NO: 618 - protein, 8 aa, Artificial
  Synthetic
QQSYSTPL

SEQ ID NO: 619 - protein, 6 aa, Artificial
  Synthetic
SSYSMN

SEQ ID NO: 620 - protein, 13 aa, Artificial
  Synthetic
WVASIKSSTGTTG

SEQ ID NO: 621 - protein, 10 aa, Artificial
  Synthetic
AREPYGYWMD

SEQ ID NO: 622 - protein, 7 aa, Artificial
  Synthetic
SSYLNWY

SEQ ID NO: 623 - protein, 10 aa, Artificial
  Synthetic
LLIYAASSLQ

SEQ ID NO: 624 - protein, 8 aa, Artificial
  Synthetic
QQSYSTPL

SEQ ID NO: 625 - protein, 6 aa, Artificial
  Synthetic
SSYAMS

SEQ ID NO: 626 - protein, 13 aa, Artificial
  Synthetic
WVASIKSSTGYIS

SEQ ID NO: 627 - protein, 10 aa, Artificial
  Synthetic
AREPYGYWMD

SEQ ID NO: 628 - protein, 7 aa, Artificial
  Synthetic
SSYLNWY

SEQ ID NO: 629 - protein, 10 aa, Artificial
  Synthetic
LLIYAASSLQ

SEQ ID NO: 630 - protein, 8 aa, Artificial
  Synthetic
QQSYSTPL

SEQ ID NO: 631 - protein, 6 aa, Artificial
  Synthetic
SSYSMS

SEQ ID NO: 632 - protein, 13 aa, Artificial
  Synthetic
WVASISGSASYSY

SEQ ID NO: 633 - protein, 10 aa, Artificial
  Synthetic
AREPYGYWMD

SEQ ID NO: 634 - protein, 7 aa, Artificial
  Synthetic
SSYLNWY

SEQ ID NO: 635 - protein, 10 aa, Artificial
  Synthetic
LLIYAASSLQ

SEQ ID NO: 636 - protein, 8 aa, Artificial
  Synthetic
QQSYSTPL

SEQ ID NO: 637 - protein, 6 aa, Artificial
  Synthetic
SSYSMS

SEQ ID NO: 638 - protein, 13 aa, Artificial
  Synthetic
WVSDIKSSAGSTY

SEQ ID NO: 639 - protein, 10 aa, Artificial
  Synthetic
AREPYGYWMD

SEQ ID NO: 640 - protein, 7 aa, Artificial
  Synthetic
SSYLNWY

SEQ ID NO: 641 - protein, 10 aa, Artificial
  Synthetic
LLIYAASSLQ

SEQ ID NO: 642 - protein, 8 aa, Artificial
  Synthetic
QQSYSTPL

SEQ ID NO: 643 - protein, 6 aa, Artificial
  Synthetic
SSYAMS

SEQ ID NO: 644 - protein, 13 aa, Artificial
  Synthetic
WVASIKSSGSYKS

SEQ ID NO: 645 - protein, 10 aa, Artificial
  Synthetic
AREPYSTWLD

SEQ ID NO: 646 - protein, 7 aa, Artificial
  Synthetic
SSYLNWY

SEQ ID NO: 647 - protein, 10 aa, Artificial
  Synthetic
LLIYAASSLQ

SEQ ID NO: 648 - protein, 8 aa, Artificial
  Synthetic
QQSYSTPL

SEQ ID NO: 649 - protein, 6 aa, Artificial
  Synthetic
SSYAMS

SEQ ID NO: 650 - protein, 13 aa, Artificial
  Synthetic
WVSAIKSDTSTIY

SEQ ID NO: 651 - protein, 10 aa, Artificial
  Synthetic
AREPYSTWLD

SEQ ID NO: 652 - protein, 7 aa, Artificial
  Synthetic
SYYLNWY

SEQ ID NO: 653 - protein, 10 aa, Artificial
  Synthetic
LLIYAASSLQ

SEQ ID NO: 654 - protein, 8 aa, Artificial
  Synthetic
QQSYSTPL

SEQ ID NO: 655 - protein, 6 aa, Artificial
  Synthetic
SSYAMS

SEQ ID NO: 656 - protein, 13 aa, Artificial
  Synthetic
WVAAIKGNAGSTS

SEQ ID NO: 657 - protein, 10 aa, Artificial
  Synthetic
AREPYSTWMD

SEQ ID NO: 658 - protein, 7 aa, Artificial
  Synthetic
SSYLNWY

SEQ ID NO: 659 - protein, 10 aa, Artificial
  Synthetic
LLIYAASSLQ

SEQ ID NO: 660 - protein, 8 aa, Artificial
  Synthetic
QQSYSTPL

SEQ ID NO: 661 - protein, 6 aa, Artificial
  Synthetic
SSYAMN

SEQ ID NO: 662 - protein, 13 aa, Artificial
  Synthetic
WVASIKSSTGTIS

SEQ ID NO: 663 - protein, 10 aa, Artificial
  Synthetic
AREPYSVWID

SEQ ID NO: 664 - protein, 7 aa, Artificial
  Synthetic
SSYLNWY

SEQ ID NO: 665 - protein, 10 aa, Artificial
  Synthetic
LLIYAASSLQ

SEQ ID NO: 666 - protein, 8 aa, Artificial
  Synthetic
QQSYSTPL

SEQ ID NO: 667 - protein, 6 aa, Artificial
  Synthetic
SSYAMS

SEQ ID NO: 668 - protein, 13 aa, Artificial
  Synthetic
WVASIKSSTGTTG

SEQ ID NO: 669 - protein, 10 aa, Artificial
  Synthetic
AREPYSVWID

SEQ ID NO: 670 - protein, 7 aa, Artificial
  Synthetic
SSYLNWY

SEQ ID NO: 671 - protein, 10 aa, Artificial
  Synthetic
LLIYAASSLQ

SEQ ID NO: 672 - protein, 8 aa, Artificial
  Synthetic
QQSYSTPL

SEQ ID NO: 673 - protein, 6 aa, Artificial
  Synthetic
SSYAMN

SEQ ID NO: 674 - protein, 13 aa, Artificial
  Synthetic
WVAYIKSDTGSIG

SEQ ID NO: 675 - protein, 10 aa, Artificial
  Synthetic
AREPYSVWID

SEQ ID NO: 676 - protein, 7 aa, Artificial
  Synthetic
SSYLNWY

SEQ ID NO: 677 - protein, 10 aa, Artificial
  Synthetic
LLIYAASSLQ

SEQ ID NO: 678 - protein, 8 aa, Artificial
  Synthetic
QQSYSTPL

SEQ ID NO: 679 - protein, 6 aa, Artificial
  Synthetic
SSYAMS

SEQ ID NO: 680 - protein, 13 aa, Artificial
  Synthetic
WVAAIKSSTGTIY

SEQ ID NO: 681 - protein, 10 aa, Artificial
  Synthetic
AREPYSVWLD

SEQ ID NO: 682 - protein, 7 aa, Artificial
  Synthetic
IYYLNWY

SEQ ID NO: 683 - protein, 10 aa, Artificial
  Synthetic
LLIYAASSLQ

SEQ ID NO: 684 - protein, 8 aa, Artificial
  Synthetic
QQSYSTPL

SEQ ID NO: 685 - protein, 6 aa, Artificial
  Synthetic
SSYSMN

SEQ ID NO: 686 - protein, 13 aa, Artificial
  Synthetic
WVAAISGDTGTSG

SEQ ID NO: 687 - protein, 10 aa, Artificial
  Synthetic
AREPYSVWLD

SEQ ID NO: 688 - protein, 7 aa, Artificial
  Synthetic
SYYLNWY

SEQ ID NO: 689 - protein, 10 aa, Artificial
  Synthetic
LLIYAASSLQ

SEQ ID NO: 690 - protein, 8 aa, Artificial
  Synthetic
QQSYSTPL

SEQ ID NO: 691 - protein, 6 aa, Artificial
  Synthetic
SSYSMS

SEQ ID NO: 692 - protein, 13 aa, Artificial
  Synthetic
WVANIKSNSGYTY

SEQ ID NO: 693 - protein, 10 aa, Artificial
  Synthetic
AREPYSVWLD

SEQ ID NO: 694 - protein, 7 aa, Artificial
  Synthetic
SSYLNWY

SEQ ID NO: 695 - protein, 10 aa, Artificial
  Synthetic
LLIYAASSLQ

SEQ ID NO: 696 - protein, 8 aa, Artificial
  Synthetic
QQSYSTPL

SEQ ID NO: 697 - protein, 6 aa, Artificial
  Synthetic
SDYSMS

SEQ ID NO: 698 - protein, 13 aa, Artificial
  Synthetic
WVARISSSSSYKS

SEQ ID NO: 699 - protein, 10 aa, Artificial
  Synthetic
AREPYSVWLD

SEQ ID NO: 700 - protein, 7 aa, Artificial
  Synthetic
SSYLNWY

SEQ ID NO: 701 - protein, 10 aa, Artificial
  Synthetic
LLIYAASSLQ

SEQ ID NO: 702 - protein, 8 aa, Artificial
  Synthetic
QQSYSTPL

SEQ ID NO: 703 - protein, 6 aa, Artificial
  Synthetic
SSYSMS

SEQ ID NO: 704 - protein, 13 aa, Artificial
  Synthetic
WVASIKSDASTTG

SEQ ID NO: 705 - protein, 10 aa, Artificial
  Synthetic
AREPYSVWLD

SEQ ID NO: 706 - protein, 7 aa, Artificial
  Synthetic
SYYLNWY

SEQ ID NO: 707 - protein, 10 aa, Artificial
  Synthetic
LLIYAASSLQ

SEQ ID NO: 708 - protein, 8 aa, Artificial
  Synthetic
QQSYSTPL

SEQ ID NO: 709 - protein, 6 aa, Artificial
  Synthetic
SSYAMS

SEQ ID NO: 710 - protein, 13 aa, Artificial
  Synthetic
WVASIKSNTGSTY

SEQ ID NO: 711 - protein, 10 aa, Artificial
  Synthetic
AREPYSVWLD

SEQ ID NO: 712 - protein, 7 aa, Artificial
  Synthetic
SSYLNWY

SEQ ID NO: 713 - protein, 10 aa, Artificial
  Synthetic
LLIYAASSLQ

SEQ ID NO: 714 - protein, 8 aa, Artificial
  Synthetic
QQSYSTPL

SEQ ID NO: 715 - protein, 6 aa, Artificial
  Synthetic
SSYAMS

SEQ ID NO: 716 - protein, 13 aa, Artificial
  Synthetic
WVAYIKSNTGSIS

SEQ ID NO: 717 - protein, 10 aa, Artificial
  Synthetic
AREPYSVWLD

SEQ ID NO: 718 - protein, 7 aa, Artificial
  Synthetic
SSYLNWY

SEQ ID NO: 719 - protein, 10 aa, Artificial
  Synthetic
LLIYAASSLQ

SEQ ID NO: 720 - protein, 8 aa, Artificial
  Synthetic
QQSYSTPL

SEQ ID NO: 721 - protein, 6 aa, Artificial
  Synthetic
SSYSMS

SEQ ID NO: 722 - protein, 13 aa, Artificial
  Synthetic
WVAYISSNTGSTY

SEQ ID NO: 723 - protein, 10 aa, Artificial
  Synthetic
AREPYSVWLD

SEQ ID NO: 724 - protein, 7 aa, Artificial
  Synthetic
SSYLNWY

SEQ ID NO: 725 - protein, 10 aa, Artificial
  Synthetic
LLIYAASSLQ

SEQ ID NO: 726 - protein, 8 aa, Artificial
  Synthetic
QQSYSTPL

SEQ ID NO: 727 - protein, 6 aa, Artificial
  Synthetic
SSYAMS

SEQ ID NO: 728 - protein, 13 aa, Artificial
  Synthetic
WVSAINSNAGYTY

SEQ ID NO: 729 - protein, 10 aa, Artificial
  Synthetic
AREPYSVWLD

SEQ ID NO: 730 - protein, 7 aa, Artificial
  Synthetic
SSYLNWY

SEQ ID NO: 731 - protein, 10 aa, Artificial
  Synthetic
LLIYAASSLQ

SEQ ID NO: 732 - protein, 8 aa, Artificial
  Synthetic
QQSYSTPL

SEQ ID NO: 733 - protein, 6 aa, Artificial
  Synthetic
SSYAMS

SEQ ID NO: 734 - protein, 13 aa, Artificial
  Synthetic
WVSAISGSGGSTY

SEQ ID NO: 735 - protein, 10 aa, Artificial
  Synthetic
AREPYSVWLD

SEQ ID NO: 736 - protein, 7 aa, Artificial
  Synthetic
SYYLNWY

SEQ ID NO: 737 - protein, 10 aa, Artificial
  Synthetic
LLIYAASSLQ

SEQ ID NO: 738 - protein, 8 aa, Artificial
  Synthetic
QQSYSTPL

SEQ ID NO: 739 - protein, 6 aa, Artificial
  Synthetic
SSYAMS

SEQ ID NO: 740 - protein, 13 aa, Artificial
  Synthetic
WVSAISGSGGSTY

SEQ ID NO: 741 - protein, 10 aa, Artificial
  Synthetic
AREPYSVWLD

SEQ ID NO: 742 - protein, 7 aa, Artificial
  Synthetic
SYYANWY

SEQ ID NO: 743 - protein, 10 aa, Artificial
  Synthetic
LLIYAASSLQ

SEQ ID NO: 744 - protein, 8 aa, Artificial
  Synthetic
QQSYSTPL

SEQ ID NO: 745 - protein, 6 aa, Artificial
  Synthetic
SSYAMS

SEQ ID NO: 746 - protein, 13 aa, Artificial
  Synthetic
WVSSIKSNTGSTY

SEQ ID NO: 747 - protein, 10 aa, Artificial
  Synthetic
AREPYSVWLD

SEQ ID NO: 748 - protein, 7 aa, Artificial
  Synthetic
SSYLNWY

SEQ ID NO: 749 - protein, 10 aa, Artificial
  Synthetic
LLIYAASSLQ

SEQ ID NO: 750 - protein, 8 aa, Artificial
  Synthetic
QQSYSTPL

SEQ ID NO: 751 - protein, 6 aa, Artificial
  Synthetic
SSYSMS

SEQ ID NO: 752 - protein, 13 aa, Artificial
  Synthetic
WVSSIKSSTGSTY

SEQ ID NO: 753 - protein, 10 aa, Artificial
  Synthetic
AREPYSVWLD

SEQ ID NO: 754 - protein, 7 aa, Artificial
  Synthetic
SSYLNWY

SEQ ID NO: 755 - protein, 10 aa, Artificial
  Synthetic
LLIYAASSLQ

SEQ ID NO: 756 - protein, 8 aa, Artificial
  Synthetic
QQSYSTPL

SEQ ID NO: 757 - protein, 6 aa, Artificial
  Synthetic
SSYAMS

SEQ ID NO: 758 - protein, 13 aa, Artificial
  Synthetic
WVAAIKSSASTIY

SEQ ID NO: 759 - protein, 10 aa, Artificial
  Synthetic
AREPYSVWMD

SEQ ID NO: 760 - protein, 7 aa, Artificial
  Synthetic
SYYLNWY

SEQ ID NO: 761 - protein, 10 aa, Artificial
  Synthetic
LLIYAASSLQ

SEQ ID NO: 762 - protein, 8 aa, Artificial
  Synthetic
QQSYSTPL

SEQ ID NO: 763 - protein, 6 aa, Artificial
  Synthetic
SSYAMS

SEQ ID NO: 764 - protein, 13 aa, Artificial
  Synthetic
WVAAIKSSASTIY

SEQ ID NO: 765 - protein, 10 aa, Artificial
  Synthetic
AREPYSVWMD

SEQ ID NO: 766 - protein, 7 aa, Artificial
  Synthetic
SYYLNWY

SEQ ID NO: 767 - protein, 10 aa, Artificial
  Synthetic
LLIYAASSLQ

SEQ ID NO: 768 - protein, 8 aa, Artificial
  Synthetic
QQSYSTPL

SEQ ID NO: 769 - protein, 6 aa, Artificial
  Synthetic
SSYAMS

SEQ ID NO: 770 - protein, 13 aa, Artificial
  Synthetic
WVAAIKSSASTIY

SEQ ID NO: 771 - protein, 10 aa, Artificial
  Synthetic
AREPYSVWMD

SEQ ID NO: 772 - protein, 7 aa, Artificial
  Synthetic
SYYLNWY

SEQ ID NO: 773 - protein, 10 aa, Artificial
  Synthetic
LLIYAASSLQ

SEQ ID NO: 774 - protein, 8 aa, Artificial
  Synthetic
QQSYSTPL

SEQ ID NO: 775 - protein, 6 aa, Artificial
  Synthetic
SSYAMN

SEQ ID NO: 776 - protein, 13 aa, Artificial
  Synthetic
WVAAISSSAGTSS

SEQ ID NO: 777 - protein, 10 aa, Artificial
  Synthetic
AREPYSVWMD

SEQ ID NO: 778 - protein, 7 aa, Artificial
  Synthetic
SSYLNWY

SEQ ID NO: 779 - protein, 10 aa, Artificial
  Synthetic
LLIYAASSLQ

SEQ ID NO: 780 - protein, 8 aa, Artificial
  Synthetic
QQSYSTPL

SEQ ID NO: 781 - protein, 6 aa, Artificial
  Synthetic
SSYAMS

SEQ ID NO: 782 - protein, 13 aa, Artificial
  Synthetic
WVADISGSASSSY

SEQ ID NO: 783 - protein, 10 aa, Artificial
  Synthetic
AREPYSVWMD

SEQ ID NO: 784 - protein, 7 aa, Artificial
  Synthetic
SYYLNWY

SEQ ID NO: 785 - protein, 10 aa, Artificial
  Synthetic
LLIYAASSLQ

SEQ ID NO: 786 - protein, 8 aa, Artificial
  Synthetic
QQSYSTPL

SEQ ID NO: 787 - protein, 6 aa, Artificial
  Synthetic
SSYAMS

SEQ ID NO: 788 - protein, 13 aa, Artificial
  Synthetic
WVASIKSSTGTSY

SEQ ID NO: 789 - protein, 10 aa, Artificial
  Synthetic
AREPYSVWMD

SEQ ID NO: 790 - protein, 7 aa, Artificial
  Synthetic
SSYLNWY

SEQ ID NO: 791 - protein, 10 aa, Artificial
  Synthetic
LLIYAASSLQ

SEQ ID NO: 792 - protein, 8 aa, Artificial
  Synthetic
QQSYSTPL

SEQ ID NO: 793 - protein, 6 aa, Artificial
  Synthetic
SSYSMS

SEQ ID NO: 794 - protein, 13 aa, Artificial
  Synthetic
WVASIKSSTGYTS

SEQ ID NO: 795 - protein, 10 aa, Artificial
  Synthetic
AREPYSVWMD

SEQ ID NO: 796 - protein, 7 aa, Artificial
  Synthetic
SSYLNWY

SEQ ID NO: 797 - protein, 10 aa, Artificial
  Synthetic
LLIYAASSLQ

SEQ ID NO: 798 - protein, 8 aa, Artificial
  Synthetic
QQSYSTPL

SEQ ID NO: 799 - protein, 6 aa, Artificial
  Synthetic
SSYAMS

SEQ ID NO: 800 - protein, 13 aa, Artificial
  Synthetic
WVASIKSSTSSTY

SEQ ID NO: 801 - protein, 10 aa, Artificial
  Synthetic
AREPYSVWMD

SEQ ID NO: 802 - protein, 7 aa, Artificial
  Synthetic
SSYLNWY

SEQ ID NO: 803 - protein, 10 aa, Artificial
  Synthetic
LLIYAASSLQ

SEQ ID NO: 804 - protein, 8 aa, Artificial
  Synthetic
QQSYSTPL

SEQ ID NO: 805 - protein, 6 aa, Artificial
  Synthetic
SSYAMS

SEQ ID NO: 806 - protein, 13 aa, Artificial
  Synthetic
WVSAISGSGGSTY

SEQ ID NO: 807 - protein, 10 aa, Artificial
  Synthetic
AREPYSVWMD

SEQ ID NO: 808 - protein, 7 aa, Artificial
  Synthetic
SSYLNWY

SEQ ID NO: 809 - protein, 10 aa, Artificial
  Synthetic
LLIYAASSLQ

SEQ ID NO: 810 - protein, 8 aa, Artificial
  Synthetic
QQSYSTPL

SEQ ID NO: 811 - protein, 6 aa, Artificial
  Synthetic
SSYAMS

SEQ ID NO: 812 - protein, 13 aa, Artificial
  Synthetic
WVSAISGSGGSTY

SEQ ID NO: 813 - protein, 10 aa, Artificial
  Synthetic
AREPYSVWMD

SEQ ID NO: 814 - protein, 7 aa, Artificial
  Synthetic
SYYLNWY

SEQ ID NO: 815 - protein, 10 aa, Artificial
  Synthetic
LLIYAASSLQ

SEQ ID NO: 816 - protein, 8 aa, Artificial
  Synthetic
QQSYSTPL

SEQ ID NO: 817 - protein, 6 aa, Artificial
  Synthetic
SSYAMS

SEQ ID NO: 818 - protein, 13 aa, Artificial
  Synthetic
WVSAISGSGGSTY

SEQ ID NO: 819 - protein, 10 aa, Artificial
  Synthetic
AREPYSVWMD

SEQ ID NO: 820 - protein, 7 aa, Artificial
  Synthetic
SSYLNWY

SEQ ID NO: 821 - protein, 10 aa, Artificial
  Synthetic
LLIYAASSLQ

SEQ ID NO: 822 - protein, 8 aa, Artificial
  Synthetic
QQSYSTPL

SEQ ID NO: 823 - protein, 6 aa, Artificial
  Synthetic
SSYAMS

SEQ ID NO: 824 - protein, 13 aa, Artificial
  Synthetic
WVSAISGSGGSTY

SEQ ID NO: 825 - protein, 10 aa, Artificial
  Synthetic
AREPYSVWMD

SEQ ID NO: 826 - protein, 7 aa, Artificial
  Synthetic
SYYLNWY

SEQ ID NO: 827 - protein, 10 aa, Artificial
  Synthetic
LLIYAASSLQ

SEQ ID NO: 828 - protein, 8 aa, Artificial
  Synthetic
QQSYSTPL

SEQ ID NO: 829 - protein, 6 aa, Artificial
  Synthetic
SSYSMN

SEQ ID NO: 830 - protein, 13 aa, Artificial
  Synthetic
WVSSIKGSAGTTS

SEQ ID NO: 831 - protein, 10 aa, Artificial
  Synthetic
AREPYSVWMD

SEQ ID NO: 832 - protein, 7 aa, Artificial
  Synthetic
SYYLNWY

SEQ ID NO: 833 - protein, 10 aa, Artificial
  Synthetic
LLIYAASSLQ

SEQ ID NO: 834 - protein, 8 aa, Artificial
  Synthetic
QQSYSTPL

SEQ ID NO: 835 - protein, 6 aa, Artificial
  Synthetic
SSYAMS

SEQ ID NO: 836 - protein, 13 aa, Artificial
  Synthetic
WVSSIKSNSGSKS

SEQ ID NO: 837 - protein, 10 aa, Artificial
  Synthetic
AREPYSVWMD

SEQ ID NO: 838 - protein, 7 aa, Artificial
  Synthetic
SSYLNWY

SEQ ID NO: 839 - protein, 10 aa, Artificial
  Synthetic
LLIYAASSLQ

SEQ ID NO: 840 - protein, 8 aa, Artificial
  Synthetic
QQSYSTPL

SEQ ID NO: 841 - protein, 6 aa, Artificial
  Synthetic
SSYSMS

SEQ ID NO: 842 - protein, 13 aa, Artificial
  Synthetic
WVAAIKGSAGSSS

SEQ ID NO: 843 - protein, 10 aa, Artificial
  Synthetic
AREPYSYWLD

SEQ ID NO: 844 - protein, 7 aa, Artificial
  Synthetic
SSYLNWY

SEQ ID NO: 845 - protein, 10 aa, Artificial
  Synthetic
LLIYAASSLQ

SEQ ID NO: 846 - protein, 8 aa, Artificial
  Synthetic
QQSYSTPL

SEQ ID NO: 847 - protein, 6 aa, Artificial
  Synthetic
SSYAMS

SEQ ID NO: 848 - protein, 13 aa, Artificial
  Synthetic
WVAAIKSNAGSSY

SEQ ID NO: 849 - protein, 10 aa, Artificial
  Synthetic
AREPYSYWLD

SEQ ID NO: 850 - protein, 7 aa, Artificial
  Synthetic
SSYLNWY

SEQ ID NO: 851 - protein, 10 aa, Artificial
  Synthetic
LLIYAASSLQ

SEQ ID NO: 852 - protein, 8 aa, Artificial
  Synthetic
QQSYSTPL

SEQ ID NO: 853 - protein, 6 aa, Artificial
  Synthetic
SSYAMS

SEQ ID NO: 854 - protein, 13 aa, Artificial
  Synthetic
WVARINSDSSNTY

SEQ ID NO: 855 - protein, 10 aa, Artificial
  Synthetic
AREPYSYWLD

SEQ ID NO: 856 - protein, 7 aa, Artificial
  Synthetic
SSYLNWY

SEQ ID NO: 857 - protein, 10 aa, Artificial
  Synthetic
LLIYAASSLQ

SEQ ID NO: 858 - protein, 8 aa, Artificial
  Synthetic
QQSYSTPL

SEQ ID NO: 859 - protein, 6 aa, Artificial
  Synthetic
SSYAMS

SEQ ID NO: 860 - protein, 13 aa, Artificial
  Synthetic
WVASIKSSSSSIS

SEQ ID NO: 861 - protein, 10 aa, Artificial
  Synthetic
AREPYSYWLD

SEQ ID NO: 862 - protein, 7 aa, Artificial
  Synthetic
SSYLNWY

SEQ ID NO: 863 - protein, 10 aa, Artificial
  Synthetic
LLIYAASSLQ

SEQ ID NO: 864 - protein, 8 aa, Artificial
  Synthetic
QQSYSTPL

SEQ ID NO: 865 - protein, 6 aa, Artificial
  Synthetic
SSYAMS

SEQ ID NO: 866 - protein, 13 aa, Artificial
  Synthetic
WVASIKSSTGYIG

SEQ ID NO: 867 - protein, 10 aa, Artificial
  Synthetic
AREPYSYWLD

SEQ ID NO: 868 - protein, 7 aa, Artificial
  Synthetic
SSYLNWY

SEQ ID NO: 869 - protein, 10 aa, Artificial
  Synthetic
LLIYAASSLQ

SEQ ID NO: 870 - protein, 8 aa, Artificial
  Synthetic
QQSYSTPL

SEQ ID NO: 871 - protein, 6 aa, Artificial
  Synthetic
SSYAMS

SEQ ID NO: 872 - protein, 13 aa, Artificial
  Synthetic
WVASINGNAGTIS

SEQ ID NO: 873 - protein, 10 aa, Artificial
  Synthetic
AREPYSYWLD

SEQ ID NO: 874 - protein, 7 aa, Artificial
  Synthetic
SSYLNWY

SEQ ID NO: 875 - protein, 10 aa, Artificial
  Synthetic
LLIYAASSLQ

SEQ ID NO: 876 - protein, 8 aa, Artificial
  Synthetic
QQSYSTPL

SEQ ID NO: 877 - protein, 6 aa, Artificial
  Synthetic
SSYAMS

SEQ ID NO: 878 - protein, 13 aa, Artificial
  Synthetic
WVASINSNTGSIG

SEQ ID NO: 879 - protein, 10 aa, Artificial
  Synthetic
AREPYSYWLD

SEQ ID NO: 880 - protein, 7 aa, Artificial
  Synthetic
SSYLNWY

SEQ ID NO: 881 - protein, 10 aa, Artificial
  Synthetic
LLIYAASSLQ

SEQ ID NO: 882 - protein, 8 aa, Artificial
  Synthetic
QQSYSTPL

SEQ ID NO: 883 - protein, 6 aa, Artificial
  Synthetic
SSYAMS

SEQ ID NO: 884 - protein, 13 aa, Artificial
  Synthetic
WVASISSSTGYTS

SEQ ID NO: 885 - protein, 10 aa, Artificial
  Synthetic
AREPYSYWLD

SEQ ID NO: 886 - protein, 7 aa, Artificial
  Synthetic
SSYLNWY

SEQ ID NO: 887 - protein, 10 aa, Artificial
  Synthetic
LLIYAASSLQ

SEQ ID NO: 888 - protein, 8 aa, Artificial
  Synthetic
QQSYSTPL

SEQ ID NO: 889 - protein, 6 aa, Artificial
  Synthetic
SSYAMS

SEQ ID NO: 890 - protein, 13 aa, Artificial
  Synthetic
WVSAISGSGGSTY

SEQ ID NO: 891 - protein, 10 aa, Artificial
  Synthetic
AREPYSYWLD

SEQ ID NO: 892 - protein, 7 aa, Artificial
  Synthetic
SSYVAWY

SEQ ID NO: 893 - protein, 10 aa, Artificial
  Synthetic
LLIYVNTSRA

SEQ ID NO: 894 - protein, 8 aa, Artificial
  Synthetic
QQWYEFNL

SEQ ID NO: 895 - protein, 6 aa, Artificial
  Synthetic
SSYAMS

SEQ ID NO: 896 - protein, 13 aa, Artificial
  Synthetic
WVSSIKSDTSSTY

SEQ ID NO: 897 - protein, 10 aa, Artificial
  Synthetic
AREPYSYWLD

SEQ ID NO: 898 - protein, 7 aa, Artificial
  Synthetic
SSYLNWY

SEQ ID NO: 899 - protein, 10 aa, Artificial
  Synthetic
LLIYAASSLQ

SEQ ID NO: 900 - protein, 8 aa, Artificial
  Synthetic
QQSYSTPL

SEQ ID NO: 901 - protein, 6 aa, Artificial
  Synthetic
SSYAMS

SEQ ID NO: 902 - protein, 13 aa, Artificial
  Synthetic
WVSSIKSNTGSTS

SEQ ID NO: 903 - protein, 10 aa, Artificial
  Synthetic
AREPYSYWLD

SEQ ID NO: 904 - protein, 7 aa, Artificial
  Synthetic
SSYLNWY

SEQ ID NO: 905 - protein, 10 aa, Artificial
  Synthetic
LLIYAASSLQ

SEQ ID NO: 906 - protein, 8 aa, Artificial
  Synthetic
QQSYSTPL

SEQ ID NO: 907 - protein, 6 aa, Artificial
  Synthetic
SSYSMN

SEQ ID NO: 908 - protein, 13 aa, Artificial
  Synthetic
WVAAISGNTGYTY

SEQ ID NO: 909 - protein, 10 aa, Artificial
  Synthetic
AREPYSYWMD

SEQ ID NO: 910 - protein, 7 aa, Artificial
  Synthetic
SSYLNWY

SEQ ID NO: 911 - protein, 10 aa, Artificial
  Synthetic
LLIYAASSLQ

SEQ ID NO: 912 - protein, 8 aa, Artificial
  Synthetic
QQSYSTPL

SEQ ID NO: 913 - protein, 6 aa, Artificial
  Synthetic
SSYAMS

SEQ ID NO: 914 - protein, 13 aa, Artificial
  Synthetic
WVANIKSNSGYTS

SEQ ID NO: 915 - protein, 10 aa, Artificial
  Synthetic
AREPYSYWMD

SEQ ID NO: 916 - protein, 7 aa, Artificial
  Synthetic
SSYLNWY

SEQ ID NO: 917 - protein, 10 aa, Artificial
  Synthetic
LLIYAASSLQ

SEQ ID NO: 918 - protein, 8 aa, Artificial
  Synthetic
QQSYSTPL

SEQ ID NO: 919 - protein, 6 aa, Artificial
  Synthetic
DSYAMN

SEQ ID NO: 920 - protein, 13 aa, Artificial
  Synthetic
WVASIKSNAGYSS

SEQ ID NO: 921 - protein, 10 aa, Artificial
  Synthetic
AREPYSYWMD

SEQ ID NO: 922 - protein, 7 aa, Artificial
  Synthetic
SSYLNWY

SEQ ID NO: 923 - protein, 10 aa, Artificial
  Synthetic
LLIYAASSLQ

SEQ ID NO: 924 - protein, 8 aa, Artificial
  Synthetic
QQSYSTPL

SEQ ID NO: 925 - protein, 6 aa, Artificial
  Synthetic
SSYAMN

SEQ ID NO: 926 - protein, 13 aa, Artificial
  Synthetic
WVASIKSNTGTTG

SEQ ID NO: 927 - protein, 10 aa, Artificial
  Synthetic
AREPYSYWMD

SEQ ID NO: 928 - protein, 7 aa, Artificial
  Synthetic
SSYLNWY

SEQ ID NO: 929 - protein, 10 aa, Artificial
  Synthetic
LLIYAASSLQ

SEQ ID NO: 930 - protein, 8 aa, Artificial
  Synthetic
QQSYSTPL

SEQ ID NO: 931 - protein, 6 aa, Artificial
  Synthetic
SSYSMS

SEQ ID NO: 932 - protein, 13 aa, Artificial
  Synthetic
WVASIKSSASYSS

SEQ ID NO: 933 - protein, 10 aa, Artificial
  Synthetic
AREPYSYWMD

SEQ ID NO: 934 - protein, 7 aa, Artificial
  Synthetic
SSYLNWY

SEQ ID NO: 935 - protein, 10 aa, Artificial
  Synthetic
LLIYAASSLQ

SEQ ID NO: 936 - protein, 8 aa, Artificial
  Synthetic
QQSYSTPL

SEQ ID NO: 937 - protein, 6 aa, Artificial
  Synthetic
SSYAMS

SEQ ID NO: 938 - protein, 13 aa, Artificial
  Synthetic
WVASIKSSGGNTY

SEQ ID NO: 939 - protein, 10 aa, Artificial
  Synthetic
AREPYSYWMD

SEQ ID NO: 940 - protein, 7 aa, Artificial
  Synthetic
SSYLNWY

SEQ ID NO: 941 - protein, 10 aa, Artificial
  Synthetic
LLIYAASSLQ

SEQ ID NO: 942 - protein, 8 aa, Artificial
  Synthetic
QQSYSTPL

SEQ ID NO: 943 - protein, 6 aa, Artificial
  Synthetic
SSYAMS

SEQ ID NO: 944 - protein, 13 aa, Artificial
  Synthetic
WVASIKSSTSSTY

SEQ ID NO: 945 - protein, 10 aa, Artificial
  Synthetic
AREPYSYWMD

SEQ ID NO: 946 - protein, 7 aa, Artificial
  Synthetic
SSYLNWY

SEQ ID NO: 947 - protein, 10 aa, Artificial
  Synthetic
LLIYAASSLQ

SEQ ID NO: 948 - protein, 8 aa, Artificial
  Synthetic
QQSYSTPL

SEQ ID NO: 949 - protein, 6 aa, Artificial
  Synthetic
SSYAMS

SEQ ID NO: 950 - protein, 13 aa, Artificial
  Synthetic
WVASISSSGGNTY

SEQ ID NO: 951 - protein, 10 aa, Artificial
  Synthetic
AREPYSYWMD

SEQ ID NO: 952 - protein, 7 aa, Artificial
  Synthetic
SSYLNWY

SEQ ID NO: 953 - protein, 10 aa, Artificial
  Synthetic
LLIYAASSLQ

SEQ ID NO: 954 - protein, 8 aa, Artificial
  Synthetic
QQSYSTPL

SEQ ID NO: 955 - protein, 6 aa, Artificial
  Synthetic
SSYAMS

SEQ ID NO: 956 - protein, 13 aa, Artificial
  Synthetic
WVSAISGSGGSTY

SEQ ID NO: 957 - protein, 10 aa, Artificial
  Synthetic
AREPYSYWMD

SEQ ID NO: 958 - protein, 7 aa, Artificial
  Synthetic
SSYLNWY

SEQ ID NO: 959 - protein, 10 aa, Artificial
  Synthetic
LLIYAASSLQ

SEQ ID NO: 960 - protein, 8 aa, Artificial
  Synthetic
QQSYSTPL

SEQ ID NO: 961 - protein, 6 aa, Artificial
  Synthetic
SSYAMN

SEQ ID NO: 962 - protein, 13 aa, Artificial
  Synthetic
WVSSISGNAGSIY

SEQ ID NO: 963 - protein, 10 aa, Artificial
  Synthetic
AREPYSYWMD

SEQ ID NO: 964 - protein, 7 aa, Artificial
  Synthetic
SSYLNWY

SEQ ID NO: 965 - protein, 10 aa, Artificial
  Synthetic
LLIYAASSLQ

SEQ ID NO: 966 - protein, 8 aa, Artificial
  Synthetic
QQSYSTPL

SEQ ID NO: 967 - protein, 6 aa, Artificial
  Synthetic
SSYAMN

SEQ ID NO: 968 - protein, 13 aa, Artificial
  Synthetic
WVSSISGNAGSIY

SEQ ID NO: 969 - protein, 10 aa, Artificial
  Synthetic
AREPYSYWMD

SEQ ID NO: 970 - protein, 7 aa, Artificial
  Synthetic
SSYLNWY

SEQ ID NO: 971 - protein, 10 aa, Artificial
  Synthetic
LLIYAASSLQ

SEQ ID NO: 972 - protein, 8 aa, Artificial
  Synthetic
QQSYSTPL

SEQ ID NO: 973 - protein, 6 aa, Artificial
  Synthetic
SSYAMN

SEQ ID NO: 974 - protein, 13 aa, Artificial
  Synthetic
WVSSISGNAGSIY

SEQ ID NO: 975 - protein, 10 aa, Artificial
  Synthetic
AREPYSYWMD

SEQ ID NO: 976 - protein, 7 aa, Artificial
  Synthetic
SSYLNWY

SEQ ID NO: 977 - protein, 10 aa, Artificial
  Synthetic
LLIYAASSLQ

SEQ ID NO: 978 - protein, 8 aa, Artificial
  Synthetic
QQSYSTPL

SEQ ID NO: 979 - protein, 6 aa, Artificial
  Synthetic
SSYGMN

SEQ ID NO: 980 - protein, 13 aa, Artificial
  Synthetic
WVAGINYSSGNKY

SEQ ID NO: 981 - protein, 11 aa, Artificial
  Synthetic
ARGPYASTWLD

SEQ ID NO: 982 - protein, 7 aa, Artificial
  Synthetic
SSYLNWY

SEQ ID NO: 983 - protein, 10 aa, Artificial
  Synthetic
LLIYAASSLQ

SEQ ID NO: 984 - protein, 8 aa, Artificial
  Synthetic
QQSYSTPL

SEQ ID NO: 985 - protein, 6 aa, Artificial
  Synthetic
SSYSMN

SEQ ID NO: 986 - protein, 13 aa, Artificial
  Synthetic
WVASIKSSSSYTS

SEQ ID NO: 987 - protein, 10 aa, Artificial
  Synthetic
ARGPYDTWLD

SEQ ID NO: 988 - protein, 7 aa, Artificial
  Synthetic
SSYLNWY

SEQ ID NO: 989 - protein, 10 aa, Artificial
  Synthetic
LLIYAASSLQ

SEQ ID NO: 990 - protein, 8 aa, Artificial
  Synthetic
QQSYSTPL

SEQ ID NO: 991 - protein, 6 aa, Artificial
  Synthetic
SSYSMH

SEQ ID NO: 992 - protein, 13 aa, Artificial
  Synthetic
WVASIKSSGGYKS

SEQ ID NO: 993 - protein, 10 aa, Artificial
  Synthetic
ARGPYDVWID

SEQ ID NO: 994 - protein, 7 aa, Artificial
  Synthetic
SSYLNWY

SEQ ID NO: 995 - protein, 10 aa, Artificial
  Synthetic
LLIYAASSLQ

SEQ ID NO: 996 - protein, 8 aa, Artificial
  Synthetic
QQSYSTPL

SEQ ID NO: 997 - protein, 6 aa, Artificial
  Synthetic
SSYTMH

SEQ ID NO: 998 - protein, 13 aa, Artificial
  Synthetic
WVANIKSSSSTKY

SEQ ID NO: 999 - protein, 10 aa, Artificial
  Synthetic
ARGPYDVWLD

SEQ ID NO: 1000 - protein, 7 aa, Artificial
  Synthetic
SSYLNWY

SEQ ID NO: 1001 - protein, 10 aa, Artificial
  Synthetic
LLIYAASSLQ

SEQ ID NO: 1002 - protein, 8 aa, Artificial
  Synthetic
QQSYSTPL

SEQ ID NO: 1003 - protein, 6 aa, Artificial
  Synthetic
SSYSMH

SEQ ID NO: 1004 - protein, 13 aa, Artificial
  Synthetic
WVASIKSSSSNKY

SEQ ID NO: 1005 - protein, 10 aa, Artificial
  Synthetic
ARGPYDVWLD

SEQ ID NO: 1006 - protein, 7 aa, Artificial
  Synthetic
SSYLNWY

SEQ ID NO: 1007 - protein, 10 aa, Artificial
  Synthetic
LLIYAASSLQ

SEQ ID NO: 1008 - protein, 8 aa, Artificial
  Synthetic
QQSYSTPL

SEQ ID NO: 1009 - protein, 6 aa, Artificial
  Synthetic
SSYGMN

SEQ ID NO: 1010 - protein, 13 aa, Artificial
  Synthetic
WVAGIKYSSGNKY

SEQ ID NO: 1011 - protein, 10 aa, Artificial
  Synthetic
ARGPYDVWMD

SEQ ID NO: 1012 - protein, 7 aa, Artificial
  Synthetic
SSYLNWY

SEQ ID NO: 1013 - protein, 10 aa, Artificial
  Synthetic
LLIYAASSLQ

SEQ ID NO: 1014 - protein, 8 aa, Artificial
  Synthetic
QQSYSTPL

SEQ ID NO: 1015 - protein, 6 aa, Artificial
  Synthetic
SDYSMN

SEQ ID NO: 1016 - protein, 13 aa, Artificial
  Synthetic
WVALIKSNSGSTS

SEQ ID NO: 1017 - protein, 10 aa, Artificial
  Synthetic
ARGPYDVWMD

SEQ ID NO: 1018 - protein, 7 aa, Artificial
  Synthetic
SSYLNWY

SEQ ID NO: 1019 - protein, 10 aa, Artificial
  Synthetic
LLIYAASSLQ

SEQ ID NO: 1020 - protein, 8 aa, Artificial
  Synthetic
QQSYSTPL

SEQ ID NO: 1021 - protein, 6 aa, Artificial
  Synthetic
DSYSMH

SEQ ID NO: 1022 - protein, 13 aa, Artificial
  Synthetic
WVANIKSSGGYIS

SEQ ID NO: 1023 - protein, 10 aa, Artificial
  Synthetic
ARGPYDVWMD

SEQ ID NO: 1024 - protein, 7 aa, Artificial
  Synthetic
SSYLNWY

SEQ ID NO: 1025 - protein, 10 aa, Artificial
  Synthetic
LLIYAASSLQ

SEQ ID NO: 1026 - protein, 8 aa, Artificial
  Synthetic
QQSYSTPL

SEQ ID NO: 1027 - protein, 6 aa, Artificial
  Synthetic
SSYSMN

SEQ ID NO: 1028 - protein, 13 aa, Artificial
  Synthetic
WVANIKSSGSSTS

SEQ ID NO: 1029 - protein, 10 aa, Artificial
  Synthetic
ARGPYDVWMD

SEQ ID NO: 1030 - protein, 7 aa, Artificial
  Synthetic
SSYLNWY

SEQ ID NO: 1031 - protein, 10 aa, Artificial
  Synthetic
LLIYAASSLQ

SEQ ID NO: 1032 - protein, 8 aa, Artificial
  Synthetic
QQSYSTPL

SEQ ID NO: 1033 - protein, 6 aa, Artificial
  Synthetic
DSYGMN

SEQ ID NO: 1034 - protein, 13 aa, Artificial
  Synthetic
WVASIKYSSGYKY

SEQ ID NO: 1035 - protein, 10 aa, Artificial
  Synthetic
ARGPYDVWMD

SEQ ID NO: 1036 - protein, 7 aa, Artificial
  Synthetic
SSYLNWY

SEQ ID NO: 1037 - protein, 10 aa, Artificial
  Synthetic
LLIYAASSLQ

SEQ ID NO: 1038 - protein, 8 aa, Artificial
  Synthetic
QQSYSTPL

SEQ ID NO: 1039 - protein, 6 aa, Artificial
  Synthetic
SSYSMN

SEQ ID NO: 1040 - protein, 13 aa, Artificial
  Synthetic
WVAYIKSNSGTKG

SEQ ID NO: 1041 - protein, 10 aa, Artificial
  Synthetic
ARGPYDYWLD

SEQ ID NO: 1042 - protein, 7 aa, Artificial
  Synthetic
SSYLNWY

SEQ ID NO: 1043 - protein, 10 aa, Artificial
  Synthetic
LLIYAASSLQ

SEQ ID NO: 1044 - protein, 8 aa, Artificial
  Synthetic
QQSYSTPL

SEQ ID NO: 1045 - protein, 6 aa, Artificial
  Synthetic
SSYGMN

SEQ ID NO: 1046 - protein, 13 aa, Artificial
  Synthetic
WVSDINSNSGSTS

SEQ ID NO: 1047 - protein, 10 aa, Artificial
  Synthetic
ARGPYGVWLD

SEQ ID NO: 1048 - protein, 7 aa, Artificial
  Synthetic
SSYLNWY

SEQ ID NO: 1049 - protein, 10 aa, Artificial
  Synthetic
LLIYAASSLQ

SEQ ID NO: 1050 - protein, 8 aa, Artificial
  Synthetic
QQSYSTPL

SEQ ID NO: 1051 - protein, 6 aa, Artificial
  Synthetic
SSYGMH

SEQ ID NO: 1052 - protein, 13 aa, Artificial
  Synthetic
WVSDISSNGGTIY

SEQ ID NO: 1053 - protein, 10 aa, Artificial
  Synthetic
ARGPYGVWLD

SEQ ID NO: 1054 - protein, 7 aa, Artificial
  Synthetic
SSYLNWY

SEQ ID NO: 1055 - protein, 10 aa, Artificial
  Synthetic
LLIYAASSLQ

SEQ ID NO: 1056 - protein, 8 aa, Artificial
  Synthetic
QQSYSTPL

SEQ ID NO: 1057 - protein, 6 aa, Artificial
  Synthetic
SSYGMH

SEQ ID NO: 1058 - protein, 13 aa, Artificial
  Synthetic
WVARINSNGGSKS

SEQ ID NO: 1059 - protein, 10 aa, Artificial
  Synthetic
ARGPYGYWFD

SEQ ID NO: 1060 - protein, 7 aa, Artificial
  Synthetic
SSYLNWY

SEQ ID NO: 1061 - protein, 10 aa, Artificial
  Synthetic
LLIYAASSLQ

SEQ ID NO: 1062 - protein, 8 aa, Artificial
  Synthetic
QQSYSTPL

SEQ ID NO: 1063 - protein, 6 aa, Artificial
  Synthetic
SSYGMN

SEQ ID NO: 1064 - protein, 13 aa, Artificial
  Synthetic
WVARISSSGSYIG

SEQ ID NO: 1065 - protein, 10 aa, Artificial
  Synthetic
ARGPYGYWLD

SEQ ID NO: 1066 - protein, 7 aa, Artificial
  Synthetic
SSYLNWY

SEQ ID NO: 1067 - protein, 10 aa, Artificial
  Synthetic
LLIYAASSLQ

SEQ ID NO: 1068 - protein, 8 aa, Artificial
  Synthetic
QQSYSTPL

SEQ ID NO: 1069 - protein, 6 aa, Artificial
  Synthetic
SSYSMH

SEQ ID NO: 1070 - protein, 13 aa, Artificial
  Synthetic
WVSAISSDGSYIS

SEQ ID NO: 1071 - protein, 10 aa, Artificial
  Synthetic
ARVPYDVWFD

SEQ ID NO: 1072 - protein, 7 aa, Artificial
  Synthetic
SSYLNWY

SEQ ID NO: 1073 - protein, 10 aa, Artificial
  Synthetic
LLIYAASSLQ

SEQ ID NO: 1074 - protein, 8 aa, Artificial
  Synthetic
QQSYSTPL

SEQ ID NO: 1075 - protein, 6 aa, Artificial
  Synthetic
SSYSMH

SEQ ID NO: 1076 - protein, 13 aa, Artificial
  Synthetic
WVAAISSNTGSIG

SEQ ID NO: 1077 - protein, 10 aa, Artificial
  Synthetic
ARVPYDVWID

SEQ ID NO: 1078 - protein, 7 aa, Artificial
  Synthetic
SSYLNWY

SEQ ID NO: 1079 - protein, 10 aa, Artificial
  Synthetic
LLIYAASSLQ

SEQ ID NO: 1080 - protein, 8 aa, Artificial
  Synthetic
QQSYSTPL

SEQ ID NO: 1081 - protein, 6 aa, Artificial
  Synthetic
SSYSMH

SEQ ID NO: 1082 - protein, 13 aa, Artificial
  Synthetic
WVASIKGNTGSSG

SEQ ID NO: 1083 - protein, 10 aa, Artificial
  Synthetic
ARVPYDVWID

SEQ ID NO: 1084 - protein, 7 aa, Artificial
  Synthetic
SSYLNWY

SEQ ID NO: 1085 - protein, 10 aa, Artificial
  Synthetic
LLIYAASSLQ

SEQ ID NO: 1086 - protein, 8 aa, Artificial
  Synthetic
QQSYSTPL

SEQ ID NO: 1087 - protein, 6 aa, Artificial
  Synthetic
SSYSMH

SEQ ID NO: 1088 - protein, 13 aa, Artificial
  Synthetic
WVASIKSNAGTSS

SEQ ID NO: 1089 - protein, 10 aa, Artificial
  Synthetic
ARVPYDVWID

SEQ ID NO: 1090 - protein, 7 aa, Artificial
  Synthetic
SSYLNWY

SEQ ID NO: 1091 - protein, 10 aa, Artificial
  Synthetic
LLIYAASSLQ

SEQ ID NO: 1092 - protein, 8 aa, Artificial
  Synthetic
QQSYSTPL

SEQ ID NO: 1093 - protein, 6 aa, Artificial
  Synthetic
SSYSMH

SEQ ID NO: 1094 - protein, 13 aa, Artificial
  Synthetic
WVASISSNAGYSS

SEQ ID NO: 1095 - protein, 10 aa, Artificial
  Synthetic
ARVPYDVWID

SEQ ID NO: 1096 - protein, 7 aa, Artificial
  Synthetic
SSYLNWY

SEQ ID NO: 1097 - protein, 10 aa, Artificial
  Synthetic
LLIYAASSLQ

SEQ ID NO: 1098 - protein, 8 aa, Artificial
  Synthetic
QQSYSTPL

SEQ ID NO: 1099 - protein, 6 aa, Artificial
  Synthetic
SSYSMS

SEQ ID NO: 1100 - protein, 13 aa, Artificial
  Synthetic
WVASISSSAGYSY

SEQ ID NO: 1101 - protein, 10 aa, Artificial
  Synthetic
ARVPYDVWID

SEQ ID NO: 1102 - protein, 7 aa, Artificial
  Synthetic
SSYLNWY

SEQ ID NO: 1103 - protein, 10 aa, Artificial
  Synthetic
LLIYAASSLQ

SEQ ID NO: 1104 - protein, 8 aa, Artificial
  Synthetic
QQSYSTPL

SEQ ID NO: 1105 - protein, 6 aa, Artificial
  Synthetic
SSYSMH

SEQ ID NO: 1106 - protein, 13 aa, Artificial
  Synthetic
WVAYIKSDTSTIG

SEQ ID NO: 1107 - protein, 10 aa, Artificial
  Synthetic
ARVPYDVWID

SEQ ID NO: 1108 - protein, 7 aa, Artificial
  Synthetic
SSYLNWY

SEQ ID NO: 1109 - protein, 10 aa, Artificial
  Synthetic
LLIYAASSLQ

SEQ ID NO: 1110 - protein, 8 aa, Artificial
  Synthetic
QQSYSTPL

SEQ ID NO: 1111 - protein, 6 aa, Artificial
  Synthetic
SSYAMH

SEQ ID NO: 1112 - protein, 13 aa, Artificial
  Synthetic
WVSSISSDTGYIG

SEQ ID NO: 1113 - protein, 10 aa, Artificial
  Synthetic
ARVPYDVWID

SEQ ID NO: 1114 - protein, 7 aa, Artificial
  Synthetic
SYYVNWY

SEQ ID NO: 1115 - protein, 10 aa, Artificial
  Synthetic
LLIYAASSLQ

SEQ ID NO: 1116 - protein, 8 aa, Artificial
  Synthetic
QQSYSTPL

SEQ ID NO: 1117 - protein, 6 aa, Artificial
  Synthetic
SSYSMS

SEQ ID NO: 1118 - protein, 13 aa, Artificial
  Synthetic
WVASIKGSAGSSS

SEQ ID NO: 1119 - protein, 10 aa, Artificial
  Synthetic
ARVPYDVWLD

SEQ ID NO: 1120 - protein, 7 aa, Artificial
  Synthetic
SSYLNWY

SEQ ID NO: 1121 - protein, 10 aa, Artificial
  Synthetic
LLIYAASSLQ

SEQ ID NO: 1122 - protein, 8 aa, Artificial
  Synthetic
QQSYSTPL

SEQ ID NO: 1123 - protein, 6 aa, Artificial
  Synthetic
SSYSMH

SEQ ID NO: 1124 - protein, 13 aa, Artificial
  Synthetic
WVSSISSSAGYTS

SEQ ID NO: 1125 - protein, 10 aa, Artificial
  Synthetic
ARVPYDVWLD

SEQ ID NO: 1126 - protein, 7 aa, Artificial
  Synthetic
SSYLNWY

SEQ ID NO: 1127 - protein, 10 aa, Artificial
  Synthetic
LLIYAASSLQ

SEQ ID NO: 1128 - protein, 8 aa, Artificial
  Synthetic
QQSYSTPL

SEQ ID NO: 1129 - protein, 6 aa, Artificial
  Synthetic
SSYSMH

SEQ ID NO: 1130 - protein, 13 aa, Artificial
  Synthetic
WVANINSNGGNTG

SEQ ID NO: 1131 - protein, 10 aa, Artificial
  Synthetic
ARVPYDVWMD

SEQ ID NO: 1132 - protein, 7 aa, Artificial
  Synthetic
SSYLNWY

SEQ ID NO: 1133 - protein, 10 aa, Artificial
  Synthetic
LLIYAASSLQ

SEQ ID NO: 1134 - protein, 8 aa, Artificial
  Synthetic
QQSYSTPL

SEQ ID NO: 1135 - protein, 6 aa, Artificial
  Synthetic
SSYSMH

SEQ ID NO: 1136 - protein, 13 aa, Artificial
  Synthetic
WVANINSNGGNTG

SEQ ID NO: 1137 - protein, 10 aa, Artificial
  Synthetic
ARVPYDVWMD

SEQ ID NO: 1138 - protein, 7 aa, Artificial
  Synthetic
SSYLNWY

SEQ ID NO: 1139 - protein, 10 aa, Artificial
  Synthetic
LLIYAASSLQ

SEQ ID NO: 1140 - protein, 8 aa, Artificial
  Synthetic
QQSYSTPL

SEQ ID NO: 1141 - protein, 6 aa, Artificial
  Synthetic
SSYSMH

SEQ ID NO: 1142 - protein, 13 aa, Artificial
  Synthetic
WVASISGSTSSSS

SEQ ID NO: 1143 - protein, 10 aa, Artificial
  Synthetic
ARVPYDVWMD

SEQ ID NO: 1144 - protein, 7 aa, Artificial
  Synthetic
SSYLNWY

SEQ ID NO: 1145 - protein, 10 aa, Artificial
  Synthetic
LLIYAASSLQ

SEQ ID NO: 1146 - protein, 8 aa, Artificial
  Synthetic
QQSYSTPL

SEQ ID NO: 1147 - protein, 6 aa, Artificial
  Synthetic
SSYGMH

SEQ ID NO: 1148 - protein, 13 aa, Artificial
  Synthetic
WVSSISSSGGTKG

SEQ ID NO: 1149 - protein, 10 aa, Artificial
  Synthetic
ARVPYDVWMD

SEQ ID NO: 1150 - protein, 7 aa, Artificial
  Synthetic
SSYLNWY

SEQ ID NO: 1151 - protein, 10 aa, Artificial
  Synthetic
LLIYAASSLQ

SEQ ID NO: 1152 - protein, 8 aa, Artificial
  Synthetic
QQSYSTPL

SEQ ID NO: 1153 - protein, 6 aa, Artificial
  Synthetic
SSYSMH

SEQ ID NO: 1154 - protein, 13 aa, Artificial
  Synthetic
WVTSISSNAGYIS

SEQ ID NO: 1155 - protein, 10 aa, Artificial
  Synthetic
ARVPYDVWMD

SEQ ID NO: 1156 - protein, 7 aa, Artificial
  Synthetic
SSYLNWY

SEQ ID NO: 1157 - protein, 10 aa, Artificial
  Synthetic
LLIYAASSLQ

SEQ ID NO: 1158 - protein, 8 aa, Artificial
  Synthetic
QQSYSTPL

SEQ ID NO: 1159 - protein, 6 aa, Artificial
  Synthetic
SSYSMH

SEQ ID NO: 1160 - protein, 13 aa, Artificial
  Synthetic
WVAAIKSDAGTSG

SEQ ID NO: 1161 - protein, 10 aa, Artificial
  Synthetic
ARVPYDYWID

SEQ ID NO: 1162 - protein, 7 aa, Artificial
  Synthetic
SSYLNWY

SEQ ID NO: 1163 - protein, 10 aa, Artificial
  Synthetic
LLIYAASSLQ

SEQ ID NO: 1164 - protein, 8 aa, Artificial
  Synthetic
QQSYSTPL

SEQ ID NO: 1165 - protein, 6 aa, Artificial
  Synthetic
SSYSMH

SEQ ID NO: 1166 - protein, 13 aa, Artificial
  Synthetic
WVASIKGNTGSIS

SEQ ID NO: 1167 - protein, 10 aa, Artificial
  Synthetic
ARVPYDYWID

SEQ ID NO: 1168 - protein, 7 aa, Artificial
  Synthetic
SSYLNWY

SEQ ID NO: 1169 - protein, 10 aa, Artificial
  Synthetic
LLIYAASSLQ

SEQ ID NO: 1170 - protein, 8 aa, Artificial
  Synthetic
QQSYSTPL

SEQ ID NO: 1171 - protein, 6 aa, Artificial
  Synthetic
SSYSMN

SEQ ID NO: 1172 - protein, 13 aa, Artificial
  Synthetic
WVASIKGSASYTS

SEQ ID NO: 1173 - protein, 10 aa, Artificial
  Synthetic
ARVPYDYWID

SEQ ID NO: 1174 - protein, 7 aa, Artificial
  Synthetic
SSYLNWY

SEQ ID NO: 1175 - protein, 10 aa, Artificial
  Synthetic
LLIYAASSLQ

SEQ ID NO: 1176 - protein, 8 aa, Artificial
  Synthetic
QQSYSTPL

SEQ ID NO: 1177 - protein, 6 aa, Artificial
  Synthetic
SSYSMH

SEQ ID NO: 1178 - protein, 13 aa, Artificial
  Synthetic
WVASIKSDTSSTY

SEQ ID NO: 1179 - protein, 10 aa, Artificial
  Synthetic
ARVPYDYWID

SEQ ID NO: 1180 - protein, 7 aa, Artificial
  Synthetic
SSYLNWY

SEQ ID NO: 1181 - protein, 10 aa, Artificial
  Synthetic
LLIYAASSLQ

SEQ ID NO: 1182 - protein, 8 aa, Artificial
  Synthetic
QQSYSTPL

SEQ ID NO: 1183 - protein, 6 aa, Artificial
  Synthetic
SSYSMS

SEQ ID NO: 1184 - protein, 13 aa, Artificial
  Synthetic
WVASIKSSAGYIS

SEQ ID NO: 1185 - protein, 10 aa, Artificial
  Synthetic
ARVPYDYWID

SEQ ID NO: 1186 - protein, 7 aa, Artificial
  Synthetic
SSYLNWY

SEQ ID NO: 1187 - protein, 10 aa, Artificial
  Synthetic
LLIYAASSLQ

SEQ ID NO: 1188 - protein, 8 aa, Artificial
  Synthetic
QQSYSTPL

SEQ ID NO: 1189 - protein, 6 aa, Artificial
  Synthetic
SSYSMH

SEQ ID NO: 1190 - protein, 13 aa, Artificial
  Synthetic
WVASISSNAGTTG

SEQ ID NO: 1191 - protein, 10 aa, Artificial
  Synthetic
ARVPYDYWID

SEQ ID NO: 1192 - protein, 7 aa, Artificial
  Synthetic
SSYLNWY

SEQ ID NO: 1193 - protein, 10 aa, Artificial
  Synthetic
LLIYAASSLQ

SEQ ID NO: 1194 - protein, 8 aa, Artificial
  Synthetic
QQSYSTPL

SEQ ID NO: 1195 - protein, 6 aa, Artificial
  Synthetic
SSYSMH

SEQ ID NO: 1196 - protein, 13 aa, Artificial
  Synthetic
WVSSIKSSAGYTY

SEQ ID NO: 1197 - protein, 10 aa, Artificial
  Synthetic
ARVPYDYWID

SEQ ID NO: 1198 - protein, 7 aa, Artificial
  Synthetic
SSYLNWY

SEQ ID NO: 1199 - protein, 10 aa, Artificial
  Synthetic
LLIYAASSLQ

SEQ ID NO: 1200 - protein, 8 aa, Artificial
  Synthetic
QQSYSTPL

SEQ ID NO: 1201 - protein, 6 aa, Artificial
  Synthetic
SSYSMH

SEQ ID NO: 1202 - protein, 13 aa, Artificial
  Synthetic
WVSSINSNAGTIS

SEQ ID NO: 1203 - protein, 10 aa, Artificial
  Synthetic
ARVPYDYWID

SEQ ID NO: 1204 - protein, 7 aa, Artificial
  Synthetic
SSYLNWY

SEQ ID NO: 1205 - protein, 10 aa, Artificial
  Synthetic
LLIYAASSLQ

SEQ ID NO: 1206 - protein, 8 aa, Artificial
  Synthetic
QQSYSTPL

SEQ ID NO: 1207 - protein, 6 aa, Artificial
  Synthetic
SSYSMN

SEQ ID NO: 1208 - protein, 13 aa, Artificial
  Synthetic
WVSSINSNAGTIY

SEQ ID NO: 1209 - protein, 10 aa, Artificial
  Synthetic
ARVPYDYWID

SEQ ID NO: 1210 - protein, 7 aa, Artificial
  Synthetic
SSYLNWY

SEQ ID NO: 1211 - protein, 10 aa, Artificial
  Synthetic
LLIYAASSLQ

SEQ ID NO: 1212 - protein, 8 aa, Artificial
  Synthetic
QQSYSTPL

SEQ ID NO: 1213 - protein, 6 aa, Artificial
  Synthetic
DSYSMH

SEQ ID NO: 1214 - protein, 13 aa, Artificial
  Synthetic
WVSSINSNGGYKY

SEQ ID NO: 1215 - protein, 10 aa, Artificial
  Synthetic
ARVPYDYWID

SEQ ID NO: 1216 - protein, 7 aa, Artificial
  Synthetic
SSYLNWY

SEQ ID NO: 1217 - protein, 10 aa, Artificial
  Synthetic
LLIYAASSLQ

SEQ ID NO: 1218 - protein, 8 aa, Artificial
  Synthetic
QQSYSTPL

SEQ ID NO: 1219 - protein, 6 aa, Artificial
  Synthetic
SSYSMN

SEQ ID NO: 1220 - protein, 13 aa, Artificial
  Synthetic
WVTSISSSASTTG

SEQ ID NO: 1221 - protein, 10 aa, Artificial
  Synthetic
ARVPYDYWID

SEQ ID NO: 1222 - protein, 7 aa, Artificial
  Synthetic
SSYLNWY

SEQ ID NO: 1223 - protein, 10 aa, Artificial
  Synthetic
LLIYAASSLQ

SEQ ID NO: 1224 - protein, 8 aa, Artificial
  Synthetic
QQSYSTPL

SEQ ID NO: 1225 - protein, 6 aa, Artificial
  Synthetic
SSYSMH

SEQ ID NO: 1226 - protein, 13 aa, Artificial
  Synthetic
WVAAIKSSGSSTS

SEQ ID NO: 1227 - protein, 10 aa, Artificial
  Synthetic
ARVPYDYWLD

SEQ ID NO: 1228 - protein, 7 aa, Artificial
  Synthetic
SSYLNWY

SEQ ID NO: 1229 - protein, 10 aa, Artificial
  Synthetic
LLIYAASSLQ

SEQ ID NO: 1230 - protein, 8 aa, Artificial
  Synthetic
QQSYSTPL

SEQ ID NO: 1231 - protein, 6 aa, Artificial
  Synthetic
SSYSMS

SEQ ID NO: 1232 - protein, 13 aa, Artificial
  Synthetic
WVASINSNAGTIS

SEQ ID NO: 1233 - protein, 10 aa, Artificial
  Synthetic
ARVPYDYWLD

SEQ ID NO: 1234 - protein, 7 aa, Artificial
  Synthetic
SSYLNWY

SEQ ID NO: 1235 - protein, 10 aa, Artificial
  Synthetic
LLIYAASSLQ

SEQ ID NO: 1236 - protein, 8 aa, Artificial
  Synthetic
QQSYSTPL

SEQ ID NO: 1237 - protein, 6 aa, Artificial
  Synthetic
SSYSMH

SEQ ID NO: 1238 - protein, 13 aa, Artificial
  Synthetic
WVSSISSSAGTSG

SEQ ID NO: 1239 - protein, 10 aa, Artificial
  Synthetic
ARVPYDYWLD

SEQ ID NO: 1240 - protein, 7 aa, Artificial
  Synthetic
SSYLNWY

SEQ ID NO: 1241 - protein, 10 aa, Artificial
  Synthetic
LLIYAASSLQ

SEQ ID NO: 1242 - protein, 8 aa, Artificial
  Synthetic
QQSYSTPL

SEQ ID NO: 1243 - protein, 6 aa, Artificial
  Synthetic
SSYSMH

SEQ ID NO: 1244 - protein, 13 aa, Artificial
  Synthetic
WVAAIKSNGGYIY

SEQ ID NO: 1245 - protein, 10 aa, Artificial
  Synthetic
ARVPYDYWMD

SEQ ID NO: 1246 - protein, 7 aa, Artificial
  Synthetic
SSYLNWY

SEQ ID NO: 1247 - protein, 10 aa, Artificial
  Synthetic
LLIYAASSLQ

SEQ ID NO: 1248 - protein, 8 aa, Artificial
  Synthetic
QQSYSTPL

SEQ ID NO: 1249 - protein, 6 aa, Artificial
  Synthetic
SSYAMH

SEQ ID NO: 1250 - protein, 13 aa, Artificial
  Synthetic
WVAAISSNTGYIY

SEQ ID NO: 1251 - protein, 10 aa, Artificial
  Synthetic
ARVPYDYWMD

SEQ ID NO: 1252 - protein, 7 aa, Artificial
  Synthetic
SSYLNWY

SEQ ID NO: 1253 - protein, 10 aa, Artificial
  Synthetic
LLIYAASSLQ

SEQ ID NO: 1254 - protein, 8 aa, Artificial
  Synthetic
QQSYSTPL

SEQ ID NO: 1255 - protein, 6 aa, Artificial
  Synthetic
SSYSMS

SEQ ID NO: 1256 - protein, 13 aa, Artificial
  Synthetic
WVAAISSSASTTS

SEQ ID NO: 1257 - protein, 10 aa, Artificial
  Synthetic
ARVPYDYWMD

SEQ ID NO: 1258 - protein, 7 aa, Artificial
  Synthetic
SSYLNWY

SEQ ID NO: 1259 - protein, 10 aa, Artificial
  Synthetic
LLIYAASSLQ

SEQ ID NO: 1260 - protein, 8 aa, Artificial
  Synthetic
QQSYSTPL

SEQ ID NO: 1261 - protein, 6 aa, Artificial
  Synthetic
SDYGMH

SEQ ID NO: 1262 - protein, 13 aa, Artificial
  Synthetic
WVAGIWYNGGYKS

SEQ ID NO: 1263 - protein, 10 aa, Artificial
  Synthetic
ARVPYDYWMD

SEQ ID NO: 1264 - protein, 7 aa, Artificial
  Synthetic
SSYLNWY

SEQ ID NO: 1265 - protein, 10 aa, Artificial
  Synthetic
LLIYAASSLQ

SEQ ID NO: 1266 - protein, 8 aa, Artificial
  Synthetic
QQSYSTPL

SEQ ID NO: 1267 - protein, 6 aa, Artificial
  Synthetic
SSYSMS

SEQ ID NO: 1268 - protein, 13 aa, Artificial
  Synthetic
WVASIKGSAGYIY

SEQ ID NO: 1269 - protein, 10 aa, Artificial
  Synthetic
ARVPYDYWMD

SEQ ID NO: 1270 - protein, 7 aa, Artificial
  Synthetic
SSYLNWY

SEQ ID NO: 1271 - protein, 10 aa, Artificial
  Synthetic
LLIYAASSLQ

SEQ ID NO: 1272 - protein, 8 aa, Artificial
  Synthetic
QQSYSTPL

SEQ ID NO: 1273 - protein, 6 aa, Artificial
  Synthetic
SSYSMH

SEQ ID NO: 1274 - protein, 13 aa, Artificial
  Synthetic
WVASIKGSASYSY

SEQ ID NO: 1275 - protein, 10 aa, Artificial
  Synthetic
ARVPYDYWMD

SEQ ID NO: 1276 - protein, 7 aa, Artificial
  Synthetic
SSYLNWY

SEQ ID NO: 1277 - protein, 10 aa, Artificial
  Synthetic
LLIYAASSLQ

SEQ ID NO: 1278 - protein, 8 aa, Artificial
  Synthetic
QQSYSTPL

SEQ ID NO: 1279 - protein, 6 aa, Artificial
  Synthetic
SSYSMH

SEQ ID NO: 1280 - protein, 13 aa, Artificial
  Synthetic
WVASIKSSGGSKY

SEQ ID NO: 1281 - protein, 10 aa, Artificial
  Synthetic
ARVPYDYWMD

SEQ ID NO: 1282 - protein, 7 aa, Artificial
  Synthetic
SSYLNWY

SEQ ID NO: 1283 - protein, 10 aa, Artificial
  Synthetic
LLIYAASSLQ

SEQ ID NO: 1284 - protein, 8 aa, Artificial
  Synthetic
QQSYSTPL

SEQ ID NO: 1285 - protein, 6 aa, Artificial
  Synthetic
SSYSMH

SEQ ID NO: 1286 - protein, 13 aa, Artificial
  Synthetic
WVASIKSSGGYIS

SEQ ID NO: 1287 - protein, 10 aa, Artificial
  Synthetic
ARVPYDYWMD

SEQ ID NO: 1288 - protein, 7 aa, Artificial
  Synthetic
SSYLNWY

SEQ ID NO: 1289 - protein, 10 aa, Artificial
  Synthetic
LLIYAASSLQ

SEQ ID NO: 1290 - protein, 8 aa, Artificial
  Synthetic
QQSYSTPL

SEQ ID NO: 1291 - protein, 6 aa, Artificial
  Synthetic
SSYSMS

SEQ ID NO: 1292 - protein, 13 aa, Artificial
  Synthetic
WVASIKSSTGTIS

SEQ ID NO: 1293 - protein, 10 aa, Artificial
  Synthetic
ARVPYDYWMD

SEQ ID NO: 1294 - protein, 7 aa, Artificial
  Synthetic
SSYLNWY

SEQ ID NO: 1295 - protein, 10 aa, Artificial
  Synthetic
LLIYAASSLQ

SEQ ID NO: 1296 - protein, 8 aa, Artificial
  Synthetic
QQSYSTPL

SEQ ID NO: 1297 - protein, 6 aa, Artificial
  Synthetic
SSYSMN

SEQ ID NO: 1298 - protein, 13 aa, Artificial
  Synthetic
WVASINSNAGSTY

SEQ ID NO: 1299 - protein, 10 aa, Artificial
  Synthetic
ARVPYDYWMD

SEQ ID NO: 1300 - protein, 7 aa, Artificial
  Synthetic
SSYLNWY

SEQ ID NO: 1301 - protein, 10 aa, Artificial
  Synthetic
LLIYAASSLQ

SEQ ID NO: 1302 - protein, 8 aa, Artificial
  Synthetic
QQSYSTPL

SEQ ID NO: 1303 - protein, 6 aa, Artificial
  Synthetic
  misc_feature (6)..(6): Xaa can be any naturally occurring amino acid
SSYSMX

SEQ ID NO: 1304 - protein, 13 aa, Artificial
  Synthetic
WVASISSSGGSIY

SEQ ID NO: 1305 - protein, 10 aa, Artificial
  Synthetic
ARVPYDYWMD

SEQ ID NO: 1306 - protein, 7 aa, Artificial
  Synthetic
SSYLNWY

SEQ ID NO: 1307 - protein, 10 aa, Artificial
  Synthetic
LLIYAASSLQ

SEQ ID NO: 1308 - protein, 8 aa, Artificial
  Synthetic
QQSYSTPL

SEQ ID NO: 1309 - protein, 6 aa, Artificial
  Synthetic
SSYSMH

SEQ ID NO: 1310 - protein, 13 aa, Artificial
  Synthetic
WVASIWSNSGNTG

SEQ ID NO: 1311 - protein, 10 aa, Artificial
  Synthetic
ARVPYDYWMD

SEQ ID NO: 1312 - protein, 7 aa, Artificial
  Synthetic
SSYLNWY

SEQ ID NO: 1313 - protein, 10 aa, Artificial
  Synthetic
LLIYAASSLQ

SEQ ID NO: 1314 - protein, 8 aa, Artificial
  Synthetic
QQSYSTPL

SEQ ID NO: 1315 - protein, 6 aa, Artificial
  Synthetic
SSYSMH

SEQ ID NO: 1316 - protein, 13 aa, Artificial
  Synthetic
WVSSIKSSASYSS

SEQ ID NO: 1317 - protein, 10 aa, Artificial
  Synthetic
ARVPYDYWMD

SEQ ID NO: 1318 - protein, 7 aa, Artificial
  Synthetic
SSYLNWY

SEQ ID NO: 1319 - protein, 10 aa, Artificial
  Synthetic
LLIYAASSLQ

SEQ ID NO: 1320 - protein, 8 aa, Artificial
  Synthetic
QQSYSTPL

SEQ ID NO: 1321 - protein, 6 aa, Artificial
  Synthetic
SSYAMH

SEQ ID NO: 1322 - protein, 13 aa, Artificial
  Synthetic
WVAAIKSSAGYSY

SEQ ID NO: 1323 - protein, 10 aa, Artificial
  Synthetic
ARVPYGVWID

SEQ ID NO: 1324 - protein, 7 aa, Artificial
  Synthetic
SYYLNWY

SEQ ID NO: 1325 - protein, 10 aa, Artificial
  Synthetic
LLIYAASSLQ

SEQ ID NO: 1326 - protein, 8 aa, Artificial
  Synthetic
QQSYSTPL

SEQ ID NO: 1327 - protein, 6 aa, Artificial
  Synthetic
SSYAMH

SEQ ID NO: 1328 - protein, 13 aa, Artificial
  Synthetic
WVADIKSNTGYTY

SEQ ID NO: 1329 - protein, 10 aa, Artificial
  Synthetic
ARVPYGVWID

SEQ ID NO: 1330 - protein, 7 aa, Artificial
  Synthetic
SYYANWY

SEQ ID NO: 1331 - protein, 10 aa, Artificial
  Synthetic
LLIYAASSLQ

SEQ ID NO: 1332 - protein, 8 aa, Artificial
  Synthetic
QQSYSTPL

SEQ ID NO: 1333 - protein, 6 aa, Artificial
  Synthetic
SSYAMS

SEQ ID NO: 1334 - protein, 13 aa, Artificial
  Synthetic
WVASIKSSTGYTY

SEQ ID NO: 1335 - protein, 10 aa, Artificial
  Synthetic
ARVPYGVWID

SEQ ID NO: 1336 - protein, 7 aa, Artificial
  Synthetic
SYYLNWY

SEQ ID NO: 1337 - protein, 10 aa, Artificial
  Synthetic
LLIYAASSLQ

SEQ ID NO: 1338 - protein, 8 aa, Artificial
  Synthetic
QQSYSTPL

SEQ ID NO: 1339 - protein, 6 aa, Artificial
  Synthetic
SSYAMH

SEQ ID NO: 1340 - protein, 13 aa, Artificial
  Synthetic
WVASISGNAGSSS

SEQ ID NO: 1341 - protein, 10 aa, Artificial
  Synthetic
ARVPYGVWID

SEQ ID NO: 1342 - protein, 7 aa, Artificial
  Synthetic
SYYLNWY

SEQ ID NO: 1343 - protein, 10 aa, Artificial
  Synthetic
LLIYAASSLQ

SEQ ID NO: 1344 - protein, 8 aa, Artificial
  Synthetic
QQSYSTPL

SEQ ID NO: 1345 - protein, 6 aa, Artificial
  Synthetic
SSYAMH

SEQ ID NO: 1346 - protein, 13 aa, Artificial
  Synthetic
WVASISGNAGSSS

SEQ ID NO: 1347 - protein, 10 aa, Artificial
  Synthetic
ARVPYGVWID

SEQ ID NO: 1348 - protein, 7 aa, Artificial
  Synthetic
SYYLNWY

SEQ ID NO: 1349 - protein, 10 aa, Artificial
  Synthetic
LLIYAASSLQ

SEQ ID NO: 1350 - protein, 8 aa, Artificial
  Synthetic
QQSYSTPL

SEQ ID NO: 1351 - protein, 6 aa, Artificial
  Synthetic
SSYSMS

SEQ ID NO: 1352 - protein, 13 aa, Artificial
  Synthetic
WVASISSSAGTTS

SEQ ID NO: 1353 - protein, 10 aa, Artificial
  Synthetic
ARVPYGVWID

SEQ ID NO: 1354 - protein, 7 aa, Artificial
  Synthetic
SSYLNWY

SEQ ID NO: 1355 - protein, 10 aa, Artificial
  Synthetic
LLIYAASSLQ

SEQ ID NO: 1356 - protein, 8 aa, Artificial
  Synthetic
QQSYSTPL

SEQ ID NO: 1357 - protein, 6 aa, Artificial
  Synthetic
SSYSMH

SEQ ID NO: 1358 - protein, 13 aa, Artificial
  Synthetic
WVASISSSASTSG

SEQ ID NO: 1359 - protein, 10 aa, Artificial
  Synthetic
ARVPYGVWID

SEQ ID NO: 1360 - protein, 7 aa, Artificial
  Synthetic
SYYLNWY

SEQ ID NO: 1361 - protein, 10 aa, Artificial
  Synthetic
LLIYAASSLQ

SEQ ID NO: 1362 - protein, 8 aa, Artificial
  Synthetic
QQSYSTPL

SEQ ID NO: 1363 - protein, 6 aa, Artificial
  Synthetic
SSYSMH

SEQ ID NO: 1364 - protein, 13 aa, Artificial
  Synthetic
WVASISSSASTSY

SEQ ID NO: 1365 - protein, 10 aa, Artificial
  Synthetic
ARVPYGVWID

SEQ ID NO: 1366 - protein, 7 aa, Artificial
  Synthetic
SSYLNWY

SEQ ID NO: 1367 - protein, 10 aa, Artificial
  Synthetic
LLIYAASSLQ

SEQ ID NO: 1368 - protein, 8 aa, Artificial
  Synthetic
QQSYSTPL

SEQ ID NO: 1369 - protein, 6 aa, Artificial
  Synthetic
SSYAMS

SEQ ID NO: 1370 - protein, 13 aa, Artificial
  Synthetic
WVSAISGSGGSTY

SEQ ID NO: 1371 - protein, 10 aa, Artificial
  Synthetic
ARVPYGVWID

SEQ ID NO: 1372 - protein, 7 aa, Artificial
  Synthetic
SYYLNWY

SEQ ID NO: 1373 - protein, 10 aa, Artificial
  Synthetic
LLIYAASSLQ

SEQ ID NO: 1374 - protein, 8 aa, Artificial
  Synthetic
QQSYSTPL

SEQ ID NO: 1375 - protein, 6 aa, Artificial
  Synthetic
SSYAMN

SEQ ID NO: 1376 - protein, 13 aa, Artificial
  Synthetic
WVAAISGNAGSSS

SEQ ID NO: 1377 - protein, 10 aa, Artificial
  Synthetic
ARVPYGVWLD

SEQ ID NO: 1378 - protein, 7 aa, Artificial
  Synthetic
SSYLNWY

SEQ ID NO: 1379 - protein, 10 aa, Artificial
  Synthetic
LLIYAASSLQ

SEQ ID NO: 1380 - protein, 8 aa, Artificial
  Synthetic
QQSYSTPL

SEQ ID NO: 1381 - protein, 6 aa, Artificial
  Synthetic
SSYAMS

SEQ ID NO: 1382 - protein, 13 aa, Artificial
  Synthetic
WVSAISGSGGSTY

SEQ ID NO: 1383 - protein, 10 aa, Artificial
  Synthetic
ARVPYGVWLD

SEQ ID NO: 1384 - protein, 7 aa, Artificial
  Synthetic
SYYLNWY

SEQ ID NO: 1385 - protein, 10 aa, Artificial
  Synthetic
LLIYAASSLQ

SEQ ID NO: 1386 - protein, 8 aa, Artificial
  Synthetic
QQSYSTPL

SEQ ID NO: 1387 - protein, 6 aa, Artificial
  Synthetic
SSYSMH

SEQ ID NO: 1388 - protein, 13 aa, Artificial
  Synthetic
WVAAIKGNTGSTY

SEQ ID NO: 1389 - protein, 10 aa, Artificial
  Synthetic
ARVPYGVWMD

SEQ ID NO: 1390 - protein, 7 aa, Artificial
  Synthetic
SSYLNWY

SEQ ID NO: 1391 - protein, 10 aa, Artificial
  Synthetic
LLIYAASSLQ

SEQ ID NO: 1392 - protein, 8 aa, Artificial
  Synthetic
QQSYSTPL

SEQ ID NO: 1393 - protein, 6 aa, Artificial
  Synthetic
SSYSMH

SEQ ID NO: 1394 - protein, 13 aa, Artificial
  Synthetic
WVAAINSNAGSSS

SEQ ID NO: 1395 - protein, 10 aa, Artificial
  Synthetic
ARVPYGVWMD

SEQ ID NO: 1396 - protein, 7 aa, Artificial
  Synthetic
SYYLNWY

SEQ ID NO: 1397 - protein, 10 aa, Artificial
  Synthetic
LLIYAASSLQ

SEQ ID NO: 1398 - protein, 8 aa, Artificial
  Synthetic
QQSYSTPL

SEQ ID NO: 1399 - protein, 6 aa, Artificial
  Synthetic
SSYSMH

SEQ ID NO: 1400 - protein, 13 aa, Artificial
  Synthetic
WVAGIWSSGGTTS

SEQ ID NO: 1401 - protein, 10 aa, Artificial
  Synthetic
ARVPYGVWMD

SEQ ID NO: 1402 - protein, 7 aa, Artificial
  Synthetic
SSYLNWY

SEQ ID NO: 1403 - protein, 10 aa, Artificial
  Synthetic
LLIYAASSLQ

SEQ ID NO: 1404 - protein, 8 aa, Artificial
  Synthetic
QQSYSTPL

SEQ ID NO: 1405 - protein, 6 aa, Artificial
  Synthetic
SSYSMH

SEQ ID NO: 1406 - protein, 13 aa, Artificial
  Synthetic
WVAYIKGSAGSTS

SEQ ID NO: 1407 - protein, 10 aa, Artificial
  Synthetic
ARVPYGVWMD

SEQ ID NO: 1408 - protein, 7 aa, Artificial
  Synthetic
SYYLNWY

SEQ ID NO: 1409 - protein, 10 aa, Artificial
  Synthetic
LLIYAASSLQ

SEQ ID NO: 1410 - protein, 8 aa, Artificial
  Synthetic
QQSYSTPL

SEQ ID NO: 1411 - protein, 6 aa, Artificial
  Synthetic
SSYSMH

SEQ ID NO: 1412 - protein, 13 aa, Artificial
  Synthetic
WVSAINSNAGSSS

SEQ ID NO: 1413 - protein, 10 aa, Artificial
  Synthetic
ARVPYGVWMD

SEQ ID NO: 1414 - protein, 7 aa, Artificial
  Synthetic
SYYLNWY

SEQ ID NO: 1415 - protein, 10 aa, Artificial
  Synthetic
LLIYAASSLQ

SEQ ID NO: 1416 - protein, 8 aa, Artificial
  Synthetic
QQSYSTPL

SEQ ID NO: 1417 - protein, 6 aa, Artificial
  Synthetic
SSYAMS

SEQ ID NO: 1418 - protein, 13 aa, Artificial
  Synthetic
WVSYISGNAGYIS

SEQ ID NO: 1419 - protein, 10 aa, Artificial
  Synthetic
ARVPYGVWMD

SEQ ID NO: 1420 - protein, 7 aa, Artificial
  Synthetic
SSYAAWY

SEQ ID NO: 1421 - protein, 10 aa, Artificial
  Synthetic
LLIYGNTSRQ

SEQ ID NO: 1422 - protein, 8 aa, Artificial
  Synthetic
QQYSNSPL

SEQ ID NO: 1423 - protein, 6 aa, Artificial
  Synthetic
SSYSMH

SEQ ID NO: 1424 - protein, 13 aa, Artificial
  Synthetic
WVASISGSTGTSY

SEQ ID NO: 1425 - protein, 10 aa, Artificial
  Synthetic
ARVPYGYWID

SEQ ID NO: 1426 - protein, 7 aa, Artificial
  Synthetic
SSYLNWY

SEQ ID NO: 1427 - protein, 10 aa, Artificial
  Synthetic
LLIYAASSLQ

SEQ ID NO: 1428 - protein, 8 aa, Artificial
  Synthetic
QQSYSTPL

SEQ ID NO: 1429 - protein, 6 aa, Artificial
  Synthetic
SSYGMH

SEQ ID NO: 1430 - protein, 13 aa, Artificial
  Synthetic
WVASISSNGGYTS

SEQ ID NO: 1431 - protein, 10 aa, Artificial
  Synthetic
ARVPYGYWID

SEQ ID NO: 1432 - protein, 7 aa, Artificial
  Synthetic
SSYLNWY

SEQ ID NO: 1433 - protein, 10 aa, Artificial
  Synthetic
LLIYAASSLQ

SEQ ID NO: 1434 - protein, 8 aa, Artificial
  Synthetic
QQSYSTPL

SEQ ID NO: 1435 - protein, 6 aa, Artificial
  Synthetic
SSYSMH

SEQ ID NO: 1436 - protein, 13 aa, Artificial
  Synthetic
WVASISSNTGTTG

SEQ ID NO: 1437 - protein, 10 aa, Artificial
  Synthetic
ARVPYGYWID

SEQ ID NO: 1438 - protein, 7 aa, Artificial
  Synthetic
SSYLNWY

SEQ ID NO: 1439 - protein, 10 aa, Artificial
  Synthetic
LLIYAASSLQ

SEQ ID NO: 1440 - protein, 8 aa, Artificial
  Synthetic
QQSYSTPL

SEQ ID NO: 1441 - protein, 6 aa, Artificial
  Synthetic
SSYAMH

SEQ ID NO: 1442 - protein, 13 aa, Artificial
  Synthetic
WVTSISSSTGYIS

SEQ ID NO: 1443 - protein, 10 aa, Artificial
  Synthetic
ARVPYGYWID

SEQ ID NO: 1444 - protein, 7 aa, Artificial
  Synthetic
SSYLNWY

SEQ ID NO: 1445 - protein, 10 aa, Artificial
  Synthetic
LLIYAASSLQ

SEQ ID NO: 1446 - protein, 8 aa, Artificial
  Synthetic
QQSYSTPL

SEQ ID NO: 1447 - protein, 6 aa, Artificial
  Synthetic
SSYAMS

SEQ ID NO: 1448 - protein, 13 aa, Artificial
  Synthetic
WVADIKSNGGYTY

SEQ ID NO: 1449 - protein, 10 aa, Artificial
  Synthetic
ARVPYGYWLD

SEQ ID NO: 1450 - protein, 7 aa, Artificial
  Synthetic
SSYLNWY

SEQ ID NO: 1451 - protein, 10 aa, Artificial
  Synthetic
LLIYAASSLQ

SEQ ID NO: 1452 - protein, 8 aa, Artificial
  Synthetic
QQSYSTPL

SEQ ID NO: 1453 - protein, 6 aa, Artificial
  Synthetic
SSYAMS

SEQ ID NO: 1454 - protein, 13 aa, Artificial
  Synthetic
WVADISGSAGTIS

SEQ ID NO: 1455 - protein, 10 aa, Artificial
  Synthetic
ARVPYGYWLD

SEQ ID NO: 1456 - protein, 7 aa, Artificial
  Synthetic
SSYLNWY

SEQ ID NO: 1457 - protein, 10 aa, Artificial
  Synthetic
LLIYAASSLQ

SEQ ID NO: 1458 - protein, 8 aa, Artificial
  Synthetic
QQSYSTPL

SEQ ID NO: 1459 - protein, 6 aa, Artificial
  Synthetic
SSYGMH

SEQ ID NO: 1460 - protein, 13 aa, Artificial
  Synthetic
WVAAIKSSGSSTS

SEQ ID NO: 1461 - protein, 10 aa, Artificial
  Synthetic
ARVPYGYWMD

SEQ ID NO: 1462 - protein, 7 aa, Artificial
  Synthetic
SSYLNWY

SEQ ID NO: 1463 - protein, 10 aa, Artificial
  Synthetic
LLIYAASSLQ

SEQ ID NO: 1464 - protein, 8 aa, Artificial
  Synthetic
QQSYSTPL

SEQ ID NO: 1465 - protein, 6 aa, Artificial
  Synthetic
SSYSMH

SEQ ID NO: 1466 - protein, 13 aa, Artificial
  Synthetic
WVASIKSNTGTTG

SEQ ID NO: 1467 - protein, 10 aa, Artificial
  Synthetic
ARVPYGYWMD

SEQ ID NO: 1468 - protein, 7 aa, Artificial
  Synthetic
SSYLNWY

SEQ ID NO: 1469 - protein, 10 aa, Artificial
  Synthetic
LLIYAASSLQ

SEQ ID NO: 1470 - protein, 8 aa, Artificial
  Synthetic
QQSYSTPL

SEQ ID NO: 1471 - protein, 6 aa, Artificial
  Synthetic
SSYAMS

SEQ ID NO: 1472 - protein, 13 aa, Artificial
  Synthetic
WVSAISGSGGSTY

SEQ ID NO: 1473 - protein, 10 aa, Artificial
  Synthetic
ARVPYGYWMD

SEQ ID NO: 1474 - protein, 7 aa, Artificial
  Synthetic
SSYLNWY

SEQ ID NO: 1475 - protein, 10 aa, Artificial
  Synthetic
LLIYAASSLQ

SEQ ID NO: 1476 - protein, 8 aa, Artificial
  Synthetic
QQSYSTPL

SEQ ID NO: 1477 - protein, 6 aa, Artificial
  Synthetic
SSYSMH

SEQ ID NO: 1478 - protein, 13 aa, Artificial
  Synthetic
WVSAISGSGGSTY

SEQ ID NO: 1479 - protein, 10 aa, Artificial
  Synthetic
ARVPYGYWMD

SEQ ID NO: 1480 - protein, 7 aa, Artificial
  Synthetic
SSYLNWY

SEQ ID NO: 1481 - protein, 10 aa, Artificial
  Synthetic
LLIYAASSLQ

SEQ ID NO: 1482 - protein, 8 aa, Artificial
  Synthetic
QQSYSTPL

SEQ ID NO: 1483 - protein, 6 aa, Artificial
  Synthetic
SSYAMS

SEQ ID NO: 1484 - protein, 13 aa, Artificial
  Synthetic
WVSSINSNAGTSY

SEQ ID NO: 1485 - protein, 10 aa, Artificial
  Synthetic
ARVPYGYWMD

SEQ ID NO: 1486 - protein, 7 aa, Artificial
  Synthetic
SSYLNWY

SEQ ID NO: 1487 - protein, 10 aa, Artificial
  Synthetic
LLIYAASSLQ

SEQ ID NO: 1488 - protein, 8 aa, Artificial
  Synthetic
QQSYSTPL

SEQ ID NO: 1489 - protein, 6 aa, Artificial
  Synthetic
SSYAMS

SEQ ID NO: 1490 - protein, 13 aa, Artificial
  Synthetic
WVSSISSNTGTIS

SEQ ID NO: 1491 - protein, 10 aa, Artificial
  Synthetic
ARVPYGYWMD

SEQ ID NO: 1492 - protein, 7 aa, Artificial
  Synthetic
SSYLNWY

SEQ ID NO: 1493 - protein, 10 aa, Artificial
  Synthetic
LLIYAASSLQ

SEQ ID NO: 1494 - protein, 8 aa, Artificial
  Synthetic
QQSYSTPL

SEQ ID NO: 1495 - protein, 6 aa, Artificial
  Synthetic
SSYTMS

SEQ ID NO: 1496 - protein, 13 aa, Artificial
  Synthetic
WVAGIWSDSGNKG

SEQ ID NO: 1497 - protein, 10 aa, Artificial
  Synthetic
ARVPYSVWID

SEQ ID NO: 1498 - protein, 7 aa, Artificial
  Synthetic
SSYLNWY

SEQ ID NO: 1499 - protein, 10 aa, Artificial
  Synthetic
LLIYAASSLQ

SEQ ID NO: 1500 - protein, 8 aa, Artificial
  Synthetic
QQSYSTPL

SEQ ID NO: 1501 - protein, 6 aa, Artificial
  Synthetic
DSYSMH

SEQ ID NO: 1502 - protein, 13 aa, Artificial
  Synthetic
WVSAISGSGGSTY

SEQ ID NO: 1503 - protein, 10 aa, Artificial
  Synthetic
ARVPYSVWID

SEQ ID NO: 1504 - protein, 7 aa, Artificial
  Synthetic
SYYLNWY

SEQ ID NO: 1505 - protein, 10 aa, Artificial
  Synthetic
LLIYAASSLQ

SEQ ID NO: 1506 - protein, 8 aa, Artificial
  Synthetic
QQSYSTPL

SEQ ID NO: 1507 - protein, 6 aa, Artificial
  Synthetic
SSYAMS

SEQ ID NO: 1508 - protein, 13 aa, Artificial
  Synthetic
WVSDIKSSAGSTS

SEQ ID NO: 1509 - protein, 10 aa, Artificial
  Synthetic
ARVPYSVWID

SEQ ID NO: 1510 - protein, 7 aa, Artificial
  Synthetic
SYYVNWY

SEQ ID NO: 1511 - protein, 10 aa, Artificial
  Synthetic
LLIYAASSLQ

SEQ ID NO: 1512 - protein, 8 aa, Artificial
  Synthetic
QQSYSTPL

SEQ ID NO: 1513 - protein, 6 aa, Artificial
  Synthetic
SSYAMH

SEQ ID NO: 1514 - protein, 13 aa, Artificial
  Synthetic
WVSGISSNGGSTS

SEQ ID NO: 1515 - protein, 10 aa, Artificial
  Synthetic
ARVPYSVWID

SEQ ID NO: 1516 - protein, 7 aa, Artificial
  Synthetic
SSYLNWY

SEQ ID NO: 1517 - protein, 10 aa, Artificial
  Synthetic
LLIYAASSLQ

SEQ ID NO: 1518 - protein, 8 aa, Artificial
  Synthetic
QQSYSTPL

SEQ ID NO: 1519 - protein, 6 aa, Artificial
  Synthetic
SSYAMH

SEQ ID NO: 1520 - protein, 13 aa, Artificial
  Synthetic
WVSGISSNGGSTS

SEQ ID NO: 1521 - protein, 10 aa, Artificial
  Synthetic
ARAPYSVWID

SEQ ID NO: 1522 - protein, 7 aa, Artificial
  Synthetic
SSYLNWY

SEQ ID NO: 1523 - protein, 10 aa, Artificial
  Synthetic
LLIYAASSLQ

SEQ ID NO: 1524 - protein, 8 aa, Artificial
  Synthetic
QQSYSTPL

SEQ ID NO: 1525 - protein, 6 aa, Artificial
  Synthetic
SSYAMS

SEQ ID NO: 1526 - protein, 13 aa, Artificial
  Synthetic
WVASIKSSTGTTY

SEQ ID NO: 1527 - protein, 10 aa, Artificial
  Synthetic
ARVPYSVWLD

SEQ ID NO: 1528 - protein, 7 aa, Artificial
  Synthetic
SSYLNWY

SEQ ID NO: 1529 - protein, 10 aa, Artificial
  Synthetic
LLIYAASSLQ

SEQ ID NO: 1530 - protein, 8 aa, Artificial
  Synthetic
QQSYSTPL

SEQ ID NO: 1531 - protein, 6 aa, Artificial
  Synthetic
SSYAMN

SEQ ID NO: 1532 - protein, 13 aa, Artificial
  Synthetic
WVASISSNTGTIG

SEQ ID NO: 1533 - protein, 10 aa, Artificial
  Synthetic
ARVPYSVWLD

SEQ ID NO: 1534 - protein, 7 aa, Artificial
  Synthetic
SSYLNWY

SEQ ID NO: 1535 - protein, 10 aa, Artificial
  Synthetic
LLIYAASSLQ

SEQ ID NO: 1536 - protein, 8 aa, Artificial
  Synthetic
QQSYSTPL

SEQ ID NO: 1537 - protein, 6 aa, Artificial
  Synthetic
NSYAMH

SEQ ID NO: 1538 - protein, 13 aa, Artificial
  Synthetic
WVAYISGNAGSIY

SEQ ID NO: 1539 - protein, 10 aa, Artificial
  Synthetic
ARVPYSVWLD

SEQ ID NO: 1540 - protein, 7 aa, Artificial
  Synthetic
SYYLNWY

SEQ ID NO: 1541 - protein, 10 aa, Artificial
  Synthetic
LLIYAASSLQ

SEQ ID NO: 1542 - protein, 8 aa, Artificial
  Synthetic
QQSYSTPL

SEQ ID NO: 1543 - protein, 6 aa, Artificial
  Synthetic
SSYGMH

SEQ ID NO: 1544 - protein, 13 aa, Artificial
  Synthetic
WVASIKSNSGNTG

SEQ ID NO: 1545 - protein, 10 aa, Artificial
  Synthetic
ARVPYSVWMD

SEQ ID NO: 1546 - protein, 7 aa, Artificial
  Synthetic
SSYLNWY

SEQ ID NO: 1547 - protein, 10 aa, Artificial
  Synthetic
LLIYAASSLQ

SEQ ID NO: 1548 - protein, 8 aa, Artificial
  Synthetic
QQSYSTPL

SEQ ID NO: 1549 - protein, 6 aa, Artificial
  Synthetic
SSYAMS

SEQ ID NO: 1550 - protein, 13 aa, Artificial
  Synthetic
WVASISSSTGTIS

SEQ ID NO: 1551 - protein, 10 aa, Artificial
  Synthetic
ARVPYSVWMD

SEQ ID NO: 1552 - protein, 7 aa, Artificial
  Synthetic
SSYLNWY

SEQ ID NO: 1553 - protein, 10 aa, Artificial
  Synthetic
LLIYAASSLQ

SEQ ID NO: 1554 - protein, 8 aa, Artificial
  Synthetic
QQSYSTPL

SEQ ID NO: 1555 - protein, 6 aa, Artificial
  Synthetic
SSYSMH

SEQ ID NO: 1556 - protein, 13 aa, Artificial
  Synthetic
WVSAISGSGGSTY

SEQ ID NO: 1557 - protein, 10 aa, Artificial
  Synthetic
ARVPYSVWMD

SEQ ID NO: 1558 - protein, 7 aa, Artificial
  Synthetic
SSYLNWY

SEQ ID NO: 1559 - protein, 10 aa, Artificial
  Synthetic
LLIYAASSLQ

SEQ ID NO: 1560 - protein, 8 aa, Artificial
  Synthetic
QQSYSTPL

SEQ ID NO: 1561 - protein, 6 aa, Artificial
  Synthetic
SSYAMS

SEQ ID NO: 1562 - protein, 13 aa, Artificial
  Synthetic
WVSSISSSASYTG

SEQ ID NO: 1563 - protein, 10 aa, Artificial
  Synthetic
ARVPYSYWID

SEQ ID NO: 1564 - protein, 7 aa, Artificial
  Synthetic
SSYLNWY

SEQ ID NO: 1565 - protein, 10 aa, Artificial
  Synthetic
LLIYAASSLQ

SEQ ID NO: 1566 - protein, 8 aa, Artificial
  Synthetic
QQSYSTPL

SEQ ID NO: 1567 - protein, 6 aa, Artificial
  Synthetic
SSYAMS

SEQ ID NO: 1568 - protein, 13 aa, Artificial
  Synthetic
WVASISSNTGSIY

SEQ ID NO: 1569 - protein, 10 aa, Artificial
  Synthetic
ARVPYSYWLD

SEQ ID NO: 1570 - protein, 7 aa, Artificial
  Synthetic
SSYLNWY

SEQ ID NO: 1571 - protein, 10 aa, Artificial
  Synthetic
LLIYAASSLQ

SEQ ID NO: 1572 - protein, 8 aa, Artificial
  Synthetic
QQSYSTPL

SEQ ID NO: 1573 - protein, 6 aa, Artificial
  Synthetic
SSYGMH

SEQ ID NO: 1574 - protein, 13 aa, Artificial
  Synthetic
WVASISSSSGYKY

SEQ ID NO: 1575 - protein, 10 aa, Artificial
  Synthetic
ARVPYSYWMD

SEQ ID NO: 1576 - protein, 7 aa, Artificial
  Synthetic
SSYLNWY

SEQ ID NO: 1577 - protein, 10 aa, Artificial
  Synthetic
LLIYAASSLQ

SEQ ID NO: 1578 - protein, 8 aa, Artificial
  Synthetic
QQSYSTPL

SEQ ID NO: 1579 - protein, 6 aa, Artificial
  Synthetic
SSYAMH

SEQ ID NO: 1580 - protein, 13 aa, Artificial
  Synthetic
WVASISSSTGSIG

SEQ ID NO: 1581 - protein, 10 aa, Artificial
  Synthetic
ARVPYSYWMD

SEQ ID NO: 1582 - protein, 7 aa, Artificial
  Synthetic
SSYLNWY

SEQ ID NO: 1583 - protein, 10 aa, Artificial
  Synthetic
LLIYAASSLQ

SEQ ID NO: 1584 - protein, 8 aa, Artificial
  Synthetic
QQSYSTPL

SEQ ID NO: 1585 - protein, 6 aa, Artificial
  Synthetic
SSYSMH

SEQ ID NO: 1586 - protein, 13 aa, Artificial
  Synthetic
WVASIKGNAGTTY

SEQ ID NO: 1587 - protein, 10 aa, Artificial
  Synthetic
AKVPYDVWMD

SEQ ID NO: 1588 - protein, 7 aa, Artificial
  Synthetic
SSYLNWY

SEQ ID NO: 1589 - protein, 10 aa, Artificial
  Synthetic
LLIYAASSLQ

SEQ ID NO: 1590 - protein, 8 aa, Artificial
  Synthetic
QQSYSTPL

SEQ ID NO: 1591 - protein, 244 aa, Artificial
  Synthetic
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 1592 - protein, 241 aa, Artificial
  Synthetic
MHGWLLLVWVQGLIQAAFLATGATAGTIDTKRNISAEEGGSVILQCHFSSDTAEVTQVDWKQQDQLLAIYSVDLGWHVASVFSDRVVPGPSLGLTFQSLTMNDTGEYFCTYHTYPGGIYKGRIFLKVQESSVAQFQTAPLGGTMAAVLGLICLMVTGVTVLARKKSIRMHSIESGLGRTEAEPQEWNLRSLSSPGSPVQTQTAPAGPCGEQAEDDYADPQEYFNVLSYRSLESFIAVSKTG

SEQ ID NO: 1593 - protein, 6 aa, Artificial
  Synthetic
SSYAMH

SEQ ID NO: 1594 - protein, 13 aa, Artificial
  Synthetic
WVSGISSNGGSTS

SEQ ID NO: 1595 - protein, 10 aa, Artificial
  Synthetic
ARVPYSVWAD

SEQ ID NO: 1596 - protein, 7 aa, Artificial
  Synthetic
SSYLNWY

SEQ ID NO: 1597 - protein, 10 aa, Artificial
  Synthetic
LLIYAASSLQ

SEQ ID NO: 1598 - protein, 8 aa, Artificial
  Synthetic
QQSYSTPL

SEQ ID NO: 1599 - protein, 10 aa, Artificial
  Synthetic
  MISC_FEATURE (1)..(1): X = A
  MISC_FEATURE (2)..(2): X = R
  MISC_FEATURE (3)..(3): X = E
  MISC_FEATURE (4)..(4): X = P
  MISC_FEATURE (5)..(5): X = Y
  MISC_FEATURE (6)..(6): X = D or G or S
  MISC_FEATURE (7)..(7): X = V or Y or T
  MISC_FEATURE (8)..(8): X = W
  MISC_FEATURE (9)..(9): X = I or L or M
  MISC_FEATURE (10)..(10): X = D
XXXXXXXXXX

SEQ ID NO: 1600 - protein, 6 aa, Artificial
  Synthetic
  MISC_FEATURE (4)..(4): X = A or G or S
  MISC_FEATURE (6)..(6): X = H or N or S
SSYXMX

SEQ ID NO: 1601 - protein, 13 aa, Artificial
  Synthetic
  MISC_FEATURE (3)..(3): X = S or A
  MISC_FEATURE (4)..(4): X = G or N or S or Y or A
  MISC_FEATURE (6)..(6): X = S or K or N
  MISC_FEATURE (7)..(7): X = S or Y or G
  MISC_FEATURE (8)..(8): X = N or S
  MISC_FEATURE (9)..(9): X = G or S or A or T
  MISC_FEATURE (10)..(10): X = G or S
  MISC_FEATURE (11)..(11): X = S or N or T
  MISC_FEATURE (12)..(12): X = T or K or S or I
  MISC_FEATURE (13)..(13): X = S or Y or G
WVXXIXXXXXXXX

SEQ ID NO: 1602 - protein, 10 aa, Artificial
  Synthetic
  MISC_FEATURE (3)..(3): X = V or A or G or E
  MISC_FEATURE (6)..(6): X = S or D or G
  MISC_FEATURE (7)..(7): X = V or Y
  MISC_FEATURE (9)..(9): X = I or A or M or L
ARXPYXXWXD

SEQ ID NO: 1603 - protein, 244 aa, Homo sapiens; identical to SEQ ID NO: 1591

SEQ ID NO: 1604 - protein, 245 aa, Macaca mulatta
MRWCLFLIWAQGLRQAPLASGMMTGTIETTGNISAKKGGSVILQCHLSSTMAQVTQVNWEQHDHSLLAIRNAELGWHIYPAFKDRVAPGPGLGLTLQSLTMNDTGEYFCTYHTYPDGTYRGRIFLEVLESSVAEHSARFQIPLLGAMAMMLVVICIAVIVVVVLARKKKSLRIHSVESGLQRKSTGQEEQIPSAPSPPGSCVQAEAAPAGLCGEQQGDDCAELHDVFNVLSYRSLGSCSFFTETG

SEQ ID NO: 1605 - protein, 245 aa, Canis familiaris
MQWYLLLIWAQGLGQAPLPTSGAVSGRIMTMGNISAKEGGSVTLQCHLSSTTANVTQVNWEKQDQLLAVHHTDLGWHIYPAFRERVAPGPNLGLTLQSLTRNDTGEYLCTYHTYPDGIYRGTFFLEVLQSSVAERSAAFQIPLLGAMASVLAVICVAVILGGLWTRKKKCRRVHCGESGLRTMTYEQEEQSPCILSSTGRAIQVEMVPVGLYTEQRADDYAEPHDYFNVLSYRSLGSFSFLAETG

SEQ ID NO: 1606 - protein, 241 aa, Mus musculus; identical to SEQ ID NO: 1592

What is claimed is:

1. An isolated antigen binding molecule that competes for binding to human TIGIT with an antibody that comprises:
    a heavy chain complementarity determining region 1 (CDR1), CDR2 and CDR3 within any of SEQ ID NO: 225-SEQ ID NO: 310; and a light chain CDR1, CDR2 and CDR3 within any one of SEQ ID NO: 311-SEQ ID NO: 396, wherein the isolated antigen binding molecule comprises a heavy chain CDR1, CDR2 and CDR3 within any of SEQ ID NO: 225-SEQ ID NO: 310; and a light chain CDR1, CDR2 and CDR3 within any of SEQ ID NO: 311-SEQ ID NO: 396.

2. The isolated antigen binding molecule of claim 1, wherein the antigen binding molecule comprises:
    the heavy chain CDR1, CDR2 and CDR3 from SEQ ID NO: 225 and the light chain CDR1, CDR2 and CDR3 from SEQ ID NO: 311;
    the heavy chain CDR1, CDR2 and CDR3 from SEQ ID NO: 226 and the light chain CDR1, CDR2 and CDR3 from SEQ ID NO: 312;
    the heavy chain CDR1, CDR2 and CDR3 from SEQ ID NO: 227 and the light chain CDR1, CDR2 and CDR3 from SEQ ID NO: 313;
    the heavy chain CDR1, CDR2 and CDR3 from SEQ ID NO: 228 and the light chain CDR1, CDR2 and CDR3 from SEQ ID NO: 314;
    the heavy chain CDR1, CDR2, and CDR3 from SEQ ID NO: 229 and the light chain CDR1, CDR2 and CDR3 from SEQ ID NO: 315;
    the heavy chain CDR1, CDR2 and CDR3 from SEQ ID NO: 230 and the light chain CDR1, CDR2 and CDR3 from SEQ ID NO: 316;
    the heavy chain CDR1, CDR2 and CDR3 from SEQ ID NO: 231 and the light chain CDR1, CDR2 and CDR3 from SEQ ID NO: 317;
    the heavy chain CDR1, CDR2 and CDR3 from SEQ ID NO: 232 and the light chain CDR1, CDR2 and CDR3 from SEQ ID NO: 318;
    the heavy chain CDR1, CDR2 and CDR3 from SEQ ID NO: 233 and the light chain CDR1, CDR2 and CDR3 from SEQ ID NO: 319;
    the heavy chain CDR1, CDR2 and CDR3 from SEQ ID NO: 234 and the light chain CDR1, CDR2 and CDR3 from SEQ ID NO: 320;
    the heavy chain CDR1, CDR2 and CDR3 from SEQ ID NO: 235 and the light chain CDR1, CDR2 and CDR3 from SEQ ID NO: 321;
    the heavy chain CDR1, CDR2 and CDR3 from SEQ ID NO: 236 and the light chain CDR1, CDR2 and CDR3 from SEQ ID NO: 322;
    the heavy chain CDR1, CDR2 and CDR3 from SE ID NO: 237 and the light chain CDR1, CDR2 and CDR3 from SEQ ID NO: 323;
    the heavy chain CDR1, CDR2 and CDR3 from SEQ ID NO: 238 and the light chain CDR1, CDR2 and CDR3 from SEQ ID NO: 324;
    the heavy chain CDR1, CDR2 and CDR3 from SEQ ID NO: 239 and the light chain CDR1 CDR2 and CDR3 from SEQ ID NO: 325;
    the heavy chain CDR1, CDR2 and CDR3 from SEQ ID NO: 240 and the light chain CDR1, CDR2 and CDR3 from SEQ ID NO: 326;
    the heavy chain CDR1, CDR2 and CDR3 from SEQ ID NO: 241 and the light chain CDR1, CDR2 and CDR3 from SEQ ID NO: 327;
    the heavy chain CDR1, CDR2 and CDR3 from SEQ ID NO: 242 and the light chain CDR1, CDR2 and CDR3 from SEQ ID NO: 328;
    the heavy chain CDR1, CDR2 and CDR3 from SEQ ID NO: 243 and the light chain CDR1, CDR2 and CDR3 from SEQ ID NO: 329;
    the heavy chain CDR1, CDR2 and CDR3 from SEQ ID NO: 244 and the light chain CDR1, CDR2 and CDR3 from SEQ ID NO: 330;
    the heavy chain CDR1, CDR2 and CDR3 from SEQ ID NO: 245 and the light chain CDR1, CDR2 and CDR3 from SEQ ID NO: 331;
    the heavy chain CDR1, CDR2 and CDR3 from SEQ ID NO: 246 and the light chain CDR1, CDR2 and CDR3 from SEQ ID NO: 332;
    the heavy chain CDR1, CDR2 and CDR3 from SEQ ID NO: 247 and the light chain CDR1, CDR2 and CDR3 from SEQ ID NO: 333;
    the heavy chain CDR1, CDR2 and CDR3 from SEQ ID NO: 248 and the light chain CDR1, CDR2 and CDR3 from SEQ ID NO: 334;
    the heavy chain CDR1, CDR2 and CDR3 from SEQ ID NO: 249 and the light chain CDR1, CDR2 and CDR3 from SEQ ID NO: 335;
    the heavy chain CDR1, CDR2 and CDR3 from SEQ ID NO: 250 and the light chain CDR1, CDR2 and CDR3 from SEQ ID NO: 336;
    the heavy chain CDR1, CDR2 and CDR3 from SEQ ID NO: 251 and the light chain CDR1, CDR2 and CDR3 from SEQ ID NO: 337;
    the heavy chain CDR1, CDR2 and CDR3 from SEQ ID NO: 252 and the light chain CDR1, CDR2 and CDR3 from SEQ ID NO: 338;
    the heavy chain CDR1, CDR2 and CDR3 from SEQ ID NO: 253 and the light chain CDR1, CDR2 and CDR3 from SEQ ID NO: 339;
    the heavy chain CDR1, CDR2 and CDR3 from SEQ ID NO: 254 and the light chain CDR1, CDR2 and CDR3 from SEQ ID NO: 340;
    the heavy chain CDR1, CDR2 and CDR3 from SEQ ID NO: 255 and the light chain CDR1, CDR2 and CDR3 from SEQ ID NO: 341;

the heavy chain CDR1, CDR2 and CDR3 from SEQ ID NO: 256 and the light chain CDR1, CDR2 and CDR3 from SEQ ID NO: 342;
the heavy chain CDR1, CDR2 and CDR3 from SEQ ID NO: 257 and the light chain CDR1, CDR2 and CDR3 from SEQ ID NO: 343;
the heavy chain CDR1, CDR2 and CDR3 from SEQ ID NO: 258 and the light chain CDR1, CDR2 and CDR3 from SEQ ID NO: 344;
the heavy chain CDR1, CDR2 and CDR3 from SEQ ID NO: 259 and the light chain CDR1, CDR2 and CDR3 from SEQ ID NO: 345;
the heavy chain CDR1, CDR2 and CDR3 from SEQ ID NO: 260 and the light chain CDR1, CDR2 and CDR3 from SEQ ID NO: 346;
the heavy chain CDR1, CDR2 and CDR3 from SEQ ID NO: 261 and the light chain CDR11, CDR2 and CDR3 from SEQ ID NO: 347;
the heavy chain CDR1, CDR2 and CDR3 from SEQ ID NO: 262 and the light chain CDR1, CDR2 and CDR3 from SEQ ID NO: 348;
the heavy chain CDR1, CDR2 and CDR3 from SEQ ID NO: 263 and the light chain CDR1, CDR2 and CDR3 from SEQ ID NO: 349;
the heavy chain CDR1, CDR2 and CDR3 from SEQ ID NO: 264 and the light chain CDR1, CDR2 and CDR3 from SEQ ID NO: 350;
the heavy chain CDR1, CDR2 and CDR3 from SEQ ID NO: 265 and the light chain CDR1, CDR2 and CDR3 from SEQ ID NO: 351;
the heavy chain CDR1, CDR2 and CDR3 from SEQ ID NO: 266 and the light chain CDR1, CDR2 and CDR3 from SEQ ID NO: 352;
the heavy chain CDR1, CDR2 and CDR3 from SEQ ID NO: 267 and the light chain CDR1, CDR2 and CDR3 from SEQ ID NO: 353;
the heavy chain CDR1, CDR2 and CDR3 from SEQ ID NO: 268 and the light chain CDR1, CDR2 and CDR3 from SEQ ID NO: 354;
the heavy chain CDR1, CDR2 and CDR3 from SEQ ID NO: 269 and the light chain CDR1, CDR2 and CDR3 from SEQ ID NO: 355;
the heavy chain CDR1, CDR2 and CDR3 from SEQ ID NO: 270 and the light chain CDR1, CDR2 and CDR3 from SEQ ID NO: 356;
the heavy chain CDR1, CDR2 and CDR3 from SEQ ID NO: 271 and the light chain CDR1, CDR2 and CDR3 from SEQ ID NO: 357;
the heavy chain CDR1, CDR2 and CDR3 from SEQ ID NO: 272 and the light chain CDR1, CDR2 and CDR3 from SEQ ID NO: 358;
the heavy chain CDR1, CDR2 and CDR3 from SEQ ID NO: 273 and the light chain CDR1, CDR2 and CDR3 from SEQ ID NO: 359;
the heavy chain CDR1, CDR2 and CDR3 from SEQ ID NO: 274 and the light chain CDR1, CDR2 and CDR3 from SEQ ID NO: 360;
the heavy chain CDR1, CDR2 and CDR3 from SEQ ID NO: 275 and the light chain CDR1, CDR2 and CDR3 from SEQ ID NO: 361;
the heavy chain CDR1, CDR2 and CDR3 from SEQ ID NO: 276 and the light chain CDR1, CDR2 and CDR3 from SEQ ID NO: 362;
the heavy chain CDR1, CDR2 and CDR3 from SEQ ID NO: 277 and the light chain CDR1, CDR2 and CDR3 from SEQ ID NO: 363;
the heavy chain CDR1, CDR2 and CDR3 from SEQ ID NO: 278 and the light chain CDR1, CDR2 and CDR3 from SEQ ID NO: 364;
the heavy chain CDR1, CDR2 and CDR3 from SEQ ID NO: 279 and the light chain CDR1, CDR2 and CDR3 from SEQ ID NO: 365;
the heavy chain CDR1, CDR2 and CDR3 from SEQ ID NO: 280 and the light chain CDR1, CDR2 and CDR3 from SEQ ID NO: 366;
the heavy chain CDR1, CDR2 and CDR3 from SEQ ID NO: 281 and the light chain CDR1, CDR2 and CDR3 from SEQ ID NO: 367;
the heavy chain CDR1, CDR2 and CDR3 from SEQ ID NO: 282 and the light chain CDR1, CDR2 and CDR3 from SEQ ID NO: 368;
the heavy chain CDR1, CDR2 and CDR3 from SEQ ID NO: 283 and the light chain CDR1, CDR2 and CDR3 from SEQ ID NO: 369;
the heavy chain CDR1, CDR2 and CDR3 from SEQ ID NO: 284 and the light chain CDR1, CDR2 and CDR3 from SEQ ID NO: 370;
the heavy chain CDR1, CDR2 and CDR3 from SEQ ID NO: 285 and the light chain CDR1, CDR2 and CDR3 from SEQ ID NO: 371;
the heavy chain CDR1, CDR2 and CDR3 from SEQ ID NO: 286 and the light chain CDR1, CDR2 and CDR3 from SEQ ID NO: 372;
the heavy chain CDR1, CDR2 and CDR3 from SEQ ID NO: 287 and the light chain CDR1, CDR2 and CDR3 from SEQ ID NO: 373;
the heavy chain CDR1, CDR2 and CDR3 from SEQ ID NO: 288 and the light chain CDR1, CDR2 and CDR3 from SEQ ID NO: 374;
the heavy chain CDR1, CDR2 and CDR3 from SEQ ID NO: 289 and the light chain CDR1, CDR2 and CDR3 from SEQ ID NO: 375;
the heavy chain CDR1, CDR2 and CDR3 from SEQ ID NO: 290 and the light chain CDR1, CDR2 and CDR3 from SEQ ID NO: 376;
the heavy chain CDR1, CDR2 and CDR3 from SEQ ID NO: 291 and the light chain CDR1, CDR2 and CDR3 from SEQ ID NO: 377;
the heavy chain CDR1, CDR2 and CDR3 from SEQ ID NO: 292 and the light chain CDR1, CDR2 and CDR3 from SEQ ID NO: 378;
the heavy chain CDR1, CDR2 and CDR3 from SEQ ID NO: 293 and the light chain CDR1, CDR2 and CDR3 from SEQ ID NO: 379;
the heavy chain CDR1, CDR2 and CDR3 from SEQ ID NO: 294 and the light chain CDR1, CDR2 and CDR3 from SEQ ID NO: 380;
the heavy chain CDR1, CDR2 and CDR3 from SEQ ID NO: 295 and the light chain CDR1, CDR2 and CDR3 from SEQ ID NO: 381;
the heavy chain CDR1, CDR2 and CDR3 from SEQ ID NO: 296 and the light chain CDR1, CDR2 and CDR3 from SEQ ID NO: 382;
the heavy chain CDR1, CDR2 and CDR3 from SE ID NO: 297 and the light chain CDR1, CDR2 and CDR3 from SEQ ID NO: 383;
the heavy chain CDR1, CDR2 and CDR3 from SEQ ID NO: 298 and the light chain CDR1, CDR2 and CDR3 from SEQ ID NO: 384;
the heavy chain CDR1, CDR2 and CDR3 from SEQ ID NO: 299 and the light chain CDR1, CDR2 and CDR3 from SEQ ID NO: 385;

the heavy chain CDR1, CDR2 and CDR3 from SEQ ID NO: 300 and the light chain CDR1, CDR2 and CDR3 from SEQ ID NO: 386;
the heavy chain CDR1, CDR2 and CDR3 from SEQ ID NO: 301 and the light chain CDR1, CDR2 and CDR3 from SEQ ID NO: 387;
the heavy chain CDR1, CDR2 and CDR3 from SEQ ID NO: 302 and the light chain CDR1, CDR2 and CDR3 from SEQ ID NO: 388;
the heavy chain CDR1, CDR2 and CDR3 from SEQ ID NO: 303 and the light chain CDR1, CDR2 and CDR3 from SEQ ID NO: 389;
the heavy chain CDR1, CDR2 and CDR3 from SEQ ID NO: 304 and the light chain CDR1, CDR2 and CDR3 from SEQ ID NO: 390;
the heavy chain CDR1, CDR2 and CDR3 from SEQ ID NO: 305 and the light chain CDR1, CDR2 and CDR3 from SEQ ID NO: 391;
the heavy chain CDR1, CDR2 and CDR3 from SEQ ID NO: 306 and the light chain CDR1, CDR2 and CDR3 from SEQ ID NO: 392;
the heavy chain CDR1, CDR2 and CDR3 from SEQ ID NO: 307 and the light chain CDR1, CDR2 and CDR3 from SEQ ID NO: 393;
the heavy chain CDR1, CDR2 and CDR3 from SEQ ID NO: 308 and the light chain CDR1, CDR2 and CDR3 from SEQ ID NO: 394;
the heavy chain CDR1, CDR2 and CDR3 from SEQ ID NO: 309 and the light chain CDR1, CDR2 and CDR3 from SEQ ID NO: 395; or
the heavy chain CDR1, CDR2 and CDR3 from SEQ ID NO: 310 and the light chain CDR1, CDR2 and CDR3 from SEQ ID NO: 396.

3. The isolated antigen binding molecule of claim 1, wherein the isolated antigen binding molecule comprises:
a heavy chain variable region comprising SEQ ID NO: 225 and a light chain variable region comprising SEQ ID NO: 311;
a heavy chain variable region comprising SEQ ID NO: 226 and a light chain variable region comprising SEQ ID NO: 312;
a heavy chain variable region comprising SEQ ID NO: 227 and a light chain variable region comprising SEQ ID NO: 313;
a heavy chain variable region comprising SEQ ID NO: 228 and a light chain variable region comprising SEQ ID NO: 314;
a heavy chain variable region comprising SEQ ID NO: 229 and a light chain variable region comprising SEQ ID NO: 315;
a heavy chain variable region comprising SEQ ID NO: 230 and a light chain variable region comprising SEQ ID NO: 316;
a heavy chain variable region comprising SEQ ID NO: 231 and a light chain variable region comprising SEQ ID NO: 317;
a heavy chain variable region comprising SEQ ID NO: 232 and a light chain variable region comprising SEQ ID NO: 318;
a heavy chain variable region comprising SEQ ID NO: 233 and a light chain variable region comprising SEQ ID NO: 319;
a heavy chain variable region comprising SEQ ID NO: 234 and a light chain variable region comprising SEQ ID NO: 320;
a heavy chain variable region comprising SEQ ID NO: 235 and a light chain variable region comprising SEQ ID NO: 321;
a heavy chain variable region comprising SEQ ID NO: 236 and a light chain variable region comprising SEQ ID NO: 322;
a heavy chain variable region comprising SEQ ID NO: 237 and a light chain variable region comprising SEQ ID NO: 323;
a heavy chain variable region comprising SEQ ID NO: 238 and a light chain variable region comprising SEQ ID NO: 324;
a heavy chain variable region comprising SEQ ID NO: 239 and a light chain variable region comprising SEQ ID NO: 325;
a heavy chain variable region comprising SEQ ID NO: 240 and a light chain variable region comprising SEQ ID NO: 326;
a heavy chain variable region comprising SEQ ID NO: 241 and a light chain variable region comprising SEQ ID NO: 327;
a heavy chain variable region comprising SEQ ID NO: 242 and a light chain variable region comprising SEQ ID NO: 328;
a heavy chain variable region comprising SEQ ID NO: 243 and a light chain variable region comprising SEQ ID NO: 329;
a heavy chain variable region comprising SEQ ID NO: 244 and a light chain variable region comprising SEQ ID NO: 330;
a heavy chain variable region comprising SEQ ID NO: 245 and a light chain variable region comprising SEQ ID NO: 331;
a heavy chain variable region comprising SEQ ID NO: 246 and a light chain variable region comprising SEQ ID NO: 332;
a heavy chain variable region comprising SEQ ID NO: 247 and a light chain variable region comprising SEQ ID NO: 333;
a heavy chain variable region comprising SEQ ID NO: 248 and a light chain variable region comprising SEQ ID NO: 334;
a heavy chain variable region comprising SEQ ID NO: 249 and a light chain variable region comprising SEQ ID NO: 335;
a heavy chain variable region comprising SEQ ID NO: 250 and a light chain variable region comprising SEQ ID NO: 336;
a heavy chain variable region comprising SEQ ID NO: 251 and a light chain variable region comprising SEQ ID NO: 337;
a heavy chain variable region comprising SEQ ID NO: 252 and a light chain variable region comprising SEQ ID NO: 338;
a heavy chain variable region comprising SEQ ID NO: 253 and a light chain variable region comprising SEQ ID NO: 339;
a heavy chain variable region comprising SEQ ID NO: 254 and a light chain variable region comprising SEQ ID NO: 340;
a heavy chain variable region comprising SEQ ID NO: 255 and a light chain variable region comprising SEQ ID NO: 341;
a heavy chain variable region comprising SEQ ID NO: 256 and a light chain variable region comprising SEQ ID NO: 342;

a heavy chain variable region comprising SEQ ID NO: 257 and a light chain variable region comprising SEQ ID NO: 343;
a heavy chain variable region comprising SEQ ID NO: 258 and a light chain variable region comprising SEQ ID NO: 344;
a heavy chain variable region comprising SEQ ID NO: 259 and a light chain variable region comprising SEQ ID NO: 345;
a heavy chain variable region comprising SEQ ID NO: 260 and a light chain variable region comprising SEQ ID NO: 346;
a heavy chain variable region comprising SEQ ID NO: 261 and a light chain variable region comprising SEQ ID NO: 347;
a heavy chain variable region comprising SEQ ID NO: 262 and a light chain variable region comprising SEQ ID NO: 348;
a heavy chain variable region comprising SEQ ID NO: 263 and a light chain variable region comprising SEQ ID NO: 349;
a heavy chain variable region comprising SEQ ID NO: 264 and a light chain variable region comprising SEQ ID NO: 350;
a heavy chain variable region comprising SEQ ID NO: 265 and a light chain variable region comprising SEQ ID NO: 351;
a heavy chain variable region comprising SEQ ID NO: 266 and a light chain variable region comprising SEQ ID NO: 352;
a heavy chain variable region comprising SEQ ID NO: 267 and a light chain variable region comprising SEQ ID NO: 353;
a heavy chain variable region comprising SEQ ID NO: 268 and a light chain variable region comprising SEQ ID NO: 354;
a heavy chain variable region comprising SEQ ID NO: 269 and a light chain variable region comprising SEQ ID NO: 355;
a heavy chain variable region comprising SEQ ID NO: 270 and a light chain variable region comprising SEQ ID NO: 356;
a heavy chain variable region comprising SEQ ID NO: 271 and a light chain variable region comprising SEQ ID NO: 357;
a heavy chain variable region comprising SEQ ID NO: 272 and a light chain variable region comprising SEQ ID NO: 358;
a heavy chain variable region comprising SEQ ID NO: 273 and a light chain variable region comprising SEQ ID NO: 359;
a heavy chain variable region comprising SEQ ID NO: 274 and a light chain variable region comprising SEQ ID NO: 360;
a heavy chain variable region comprising SEQ ID NO: 275 and a light chain variable region comprising SEQ ID NO: 361;
a heavy chain variable region comprising SEQ ID NO: 276 and a light chain variable region comprising SEQ ID NO: 362;
a heavy chain variable region comprising SEQ ID NO: 277 and a light chain variable region comprising SEQ ID NO: 363;
a heavy chain variable region comprising SEQ ID NO: 278 and a light chain variable region comprising SEQ ID NO: 364;
a heavy chain variable region comprising SEQ ID NO: 279 and a light chain variable region comprising SEQ ID NO: 365;
a heavy chain variable region comprising SEQ ID NO: 280 and a light chain variable region comprising SEQ ID NO: 366;
a heavy chain variable region comprising SEQ ID NO: 281 and a light chain variable region comprising SEQ ID NO: 367;
a heavy chain variable region comprising SEQ ID NO: 282 and a light chain variable region comprising SEQ ID NO: 368;
a heavy chain variable region comprising SEQ ID NO: 283 and a light chain variable region comprising SEQ ID NO: 369;
a heavy chain variable region comprising SEQ ID NO: 284 and a light chain variable region comprising SEQ ID NO: 370;
a heavy chain variable region comprising SEQ ID NO: 285 and a light chain variable region comprising SEQ ID NO: 371;
a heavy chain variable region comprising SEQ ID NO: 286 and a light chain variable region comprising SEQ ID NO: 372;
a heavy chain variable region comprising SEQ ID NO: 287 and a light chain variable region comprising SEQ ID NO: 373;
a heavy chain variable region comprising SEQ ID NO: 288 and a light chain variable region comprising SEQ ID NO: 374;
a heavy chain variable region comprising SEQ ID NO: 289 and a light chain variable region comprising SEQ ID NO: 375;
a heavy chain variable region comprising SEQ ID NO: 290 and a light chain variable region comprising SEQ ID NO: 376;
a heavy chain variable region comprising SEQ ID NO: 291 and a light chain variable region comprising SEQ ID NO: 377;
a heavy chain variable region comprising SEQ ID NO: 292 and a light chain variable region comprising SEQ ID NO: 378;
a heavy chain variable region comprising SEQ ID NO: 293 and a light chain variable region comprising SEQ ID NO: 379;
a heavy chain variable region comprising SEQ ID NO: 294 and a light chain variable region comprising SEQ ID NO: 380;
a heavy chain variable region comprising SEQ ID NO: 295 and a light chain variable region comprising SEQ ID NO: 381;
a heavy chain variable region comprising SEQ ID NO: 296 and a light chain variable region comprising SEQ ID NO: 382;
a heavy chain variable region comprising SEQ ID NO: 297 and a light chain variable region comprising SEQ ID NO: 383;
a heavy chain variable region comprising SEQ ID NO: 298 and a light chain variable region comprising SEQ ID NO: 384;
a heavy chain variable region comprising SEQ ID NO: 299 and a light chain variable region comprising SEQ ID NO: 385;
a heavy chain variable region comprising SEQ ID NO: 300 and a light chain variable region comprising SEQ ID NO: 386;

a heavy chain variable region comprising SEQ ID NO: 301 and a light chain variable region comprising SEQ ID NO: 387;

a heavy chain variable region comprising SEQ ID NO: 302 and a light chain variable region comprising SEQ ID NO: 388;

a heavy chain variable region comprising SEQ ID NO: 303 and a light chain variable region comprising SEQ ID NO: 389;

a heavy chain variable region comprising SEQ ID NO: 304 and a light chain variable region comprising SEQ ID NO: 390;

a heavy chain variable region comprising SEQ ID NO: 305 and a light chain variable region comprising SEQ ID NO: 391;

a heavy chain variable region comprising SEQ ID NO: 306 and a light chain variable region comprising SEQ ID NO: 392;

a heavy chain variable region comprising SEQ ID NO: 307 and a light chain variable region comprising SEQ ID NO: 393;

a heavy chain variable region comprising SEQ ID NO: 308 and a light chain variable region comprising SEQ ID NO: 394;

a heavy chain variable region comprising SEQ ID NO: 309 and a light chain variable A region comprising SEQ ID NO: 395; or a heavy chain variable region comprising SEQ ID NO: 310 and a light chain variable A region comprising SEQ ID NO: 396.

4. The isolated antigen binding molecule of claim 1, wherein the isolated antigen binding molecules comprises:

(a) a heavy chain CDR1 (HCDR1) comprising the amino acid sequence of any one of SEQ ID NO: 1069, SEQ ID NO: 1075, SEQ ID NO: 1081, SEQ ID NO: 1087, SEQ ID NO: 1093, SEQ ID NO: 1099, SEQ ID NO: 1105, SEQ ID NO: 1111, ID NO: 1117, SEQ ID NO: 1123, SEQ ID NO: 1129, SEQ ID NO: 1135, SEQ ID NO: 1141, SEQ ID NO: 1147, SEQ ID NO: 1153, SEQ ID NO: 1159, SEQ ID NO: 1165, SEQ ID NO: 1171, SEQ ID NO: 1177 SEQ ID NO: 1183, SEQ ID NO: 1189 SEQ ID NO: 1195, SEQ ID NO: 1201, SEQ ID NO: 1207 SEQ ID NO: 1213, SEQ ID NO: 1219, SEQ ID NO: 1225, SEQ ID NO: 1231, SEQ ID NO: 1237, SEQ ID NO: 1243, SEQ ID NO: 1249, SEQ ID NO: 1255, SEQ ID NO: 1261, SEQ ID NO: 1267, SEQ ID NO: 1273, SEQ ID NO: 1279, SEQ ID NO: 1285, SEQ ID NO: 1291, SEQ ID NO: 1297, SEQ ID NO: 13031 SEQ ID NO: 1309, SEQ ID NO: 1315, SEQ ID NO: 1321, SEQ ID NO: 132147, SEQ ID NO: 1333, SEQ ID NO: 133159, SEQ ID NO: 1345, SEQ ID NO: 1351, SEQ ID NO: 1357, SEQ ID NO: 1363, SEQ ID NO: 1369, SEQ ID NO: 1375, SEQ ID NO: 1381, SEQ ID NO: 1387, SEQ ID NO: 1393, SEQ ID NO: 1399, SEQ ID NO: 1405, SEQ ID NO: 1411, SEQ ID NO: 1417, SEQ ID NO: 1423, SEQ ID NO: 1429, SEQ ID NO: 1435, SEQ ID NO: 1441, SEQ ID NO: 1447, SEQ ID NO: 1453, SEQ ID NO: 1459, SEQ ID NO: 1465, SEQ ID NO: 1471, SEQ ID NO: 1477, SEQ ID NO: 1483, SEQ ID NO: 1489, SEQ ID NO: 1495, SEQ ID NO: 1501, SEQ ID NO: 1507, SEQ ID NO: 1513, SEQ ID NO: 1519, SEQ ID NO: 1593, SEQ ID NO: 1525 SEQ ID NO: 1531, SEQ ID NO: 1537, SEQ ID NO: 1543, SEQ ID NO: 1549, SEQ ID NO: 1555, SEQ ID NO: 1561, SEQ ID NO: 1567, SEQ ID NO: 1573, SEQ ID NO: 1579, and SEQ ID NO: 1585;

(b) a heavy chain CDR2 (HCDR2) comprising the amino acid sequence of any one of SEQ ID NO: 1070, SEQ ID NO: 1076, SEQ ID NO: 1082, SEQ ID NO: 1088, SEQ ID NO: 1094, SEQ ID NO: 1100, SEQ ID NO: 1106, SEQ ID NO: 1112, SEQ ID NO: 1118, SEQ ID NO: 1124, SEQ ID NO: 1130, SEQ ID NO: 1136, SEQ ID NO: 1142, SEQ ID NO: 1148, SEQ ID NO: 1154, SEQ ID NO: 1160, SEQ ID NO: 1166, SEQ ID NO: 1172, SEQ ID NO: 1178, SEQ ID NO: 1184, SEQ ID NO: 1190, SEQ ID NO: 1196, SEQ ID NO: 1202, SEQ ID NO: 1208, SEQ ID NO: 1214, SEQ ID NO: 1220, SEQ ID NO: 1226, SEQ ID NO: 1232, SEQ ID NO: 1238, SEQ ID NO: 1244, SEQ ID NO: 1250, SEQ ID NO: 1256, SEQ ID NO: 1262, SEQ ID NO: 1268, SEQ ID NO: 1274, SEQ ID NO: 1280, SEQ ID NO: 1286, SEQ ID NO: 1292, SEQ ID NO: 1298, SEQ ID NO: 1304, SEQ ID NO: 1310, SEQ ID NO: 1316, SEQ ID NO: 1322, SEQ ID NO: 1328, SEQ ID NO: 1334, SEQ ID NO: 1340, SEQ ID NO: 1346, SEQ ID NO: 1352, SEQ ID NO: 1358, SEQ ID NO: 1364, SEQ ID NO: 1370, SEQ ID NO: 1376, SEQ ID NO: 1382, SEQ ID NO: 1388, SEQ ID NO: 1394, SEQ ID NO: 1400, SEQ ID NO: 1406, SEQ ID NO: 1412, SEQ ID NO: 1418, SEQ ID NO: 1424, SEQ ID NO: 1430, SEQ ID NO: 1436, SEQ ID NO: 1442, SEQ ID NO: 1448, SEQ ID NO: 1454, SEQ ID NO: 1460, SEQ ID NO: 1466, SEQ ID NO: 1472, SEQ ID NO: 1478, SEQ ID NO: 1484, SEQ ID NO: 1490, SEQ ID NO: 1496, SEQ ID NO: 1502, SEQ ID NO: 1508, SEQ ID NO: 1514, SEQ ID NO: 1520, SEQ ID NO: 1594, SEQ ID NO: 1526, SEQ ID NO: 1532, SEQ ID NO: 1538, SEQ ID NO: 1544, SEQ ID NO: 1550, SEQ ID NO: 1556, SEQ ID NO: 1562, SEQ ID NO: 1568, SEQ ID NO: 1574, SEQ ID NO: 1580, and SEQ ID NO: 1586; and (c) a heavy chain CDR3 (HCDR3) comprising the amino acid sequence of any one of SEQ ID NO: 1071, SEQ ID NO: 1077, SEQ ID NO: 1083, SEQ ID NO: 1089, SEQ ID NO: 1095, SEQ ID NO: 1101, SEQ ID NO: 1107, SEQ ID NO: 1113, SEQ ID NO: 1119, SEQ ID NO: 1125, SEQ ID NO: 1131, SEQ ID NO 1137, SEQ ID NO: 1143, SEQ ID NO: 1149, SEQ ID NO: 1155, SEQ ID NO: 1161, SEQ ID NO: 1167, SEQ ID NO: 1173, SEQ ID NO: 1179, SEQ ID NO: 1185, SEQ ID NO: 1191, SEQ ID NO: 1197, SEQ ID NO: 1203, SEQ ID NO: 1209, SEQ ID NO: 1215, SEQ ID NO: 1221, SEQ ID NO: 1227, SEQ ID NO: 1233, SEQ ID NO: 1239, SEQ ID NO: 1245, SEQ ID NO: 1251, SEQ ID NO: 1257, SEQ ID NO: 1263, SEQ ID NO: 1269, SEQ ID NO: 1275, SEQ ID NO: 1281, SEQ ID NO: 1287, SEQ ID NO: 1293, SEQ ID NO: 1299, SEQ ID NO: 1305, SEQ ID NO: 1311, SEQ ID NO: 1317, SEQ ID NO: 1323, SEQ ID NO: 1329, SEQ ID NO: 1335, SEQ ID NO: 1341, SEQ ID NO: 1347, SEQ ID NO: 1353, SEQ ID NO: 1359, SEQ ID NO: 1365, SEQ ID NO: 1371, SEQ ID NO: 1377, SEQ ID NO: 1383, SEQ ID NO: 1389, SEQ ID NO: 1395, SEQ ID NO: 1401, SEQ ID NO: 1407, SEQ ID NO: 1413, SEQ ID NO: 1419, SEQ ID NO: 1425, SEQ ID NO: 1431, SEQ ID NO: 1437, SEQ ID NO: 1443, SEQ ID NO: 1449, SEQ ID NO: 1455, SEQ ID NO: 1461, SEQ ID NO: 1467, SEQ ID NO: 1473, SEQ ID NO: 1479, SEQ ID NO: 1485, SEQ ID NO: 1491, SEQ ID NO: 1497, SEQ ID NO: 1503, SEQ ID NO: 1509, SEQ ID NO: 1515, SEQ ID NO: 1521, SEQ ID NO: 1595, SEQ ID NO: 1527, SEQ ID NO: 1533, SEQ ID NO: 1539, SEQ ID NO: 1545, SEQ ID NO: 1551, SEQ ID NO: 1557, SEQ ID NO:

1563, SEQ ID NO: 1569, SEQ ID NO: 1575, SEQ ID NO: 1581, and SEQ ID NO: 1587, wherein the HCDR1, HCDR2, and HCDR3 are from a same clone.

5. The isolated antigen binding molecule of claim 1, wherein the isolated antigen binding molecule comprises germline light chain CDRs.

6. The isolated antigen binding molecule of claim 4, wherein the isolated antigen binding molecule comprises germline light chain CDRs.

7. An isolated antigen binding molecule comprising a heavy chain complementarity determining region 1 (CDR1), CDR2 and CDR3 from within any of SEQ ID NO: 225-SEQ ID NO: 310; and a light chain CDR1, CDR2 and CDR3 within any of SEQ ID NO: 396.

8. The isolated antigen binding molecule of claim 7, wherein the isolated antigen binding molecule comprises germline light chain CDRs.

9. A method of increasing T cell activation in a subject, the method comprising administering any one or more of the isolated antigen binding molecules of claim 1 to the subject in an amount sufficient to block TIGIT in the subject.

* * * * *